(12) United States Patent
Sharpe et al.

(10) Patent No.: US 8,846,374 B2
(45) Date of Patent: Sep. 30, 2014

(54) CAROTENOID PRODUCTION IN A RECOMBINANT OLEAGINOUS YEAST

(75) Inventors: Pamela L. Sharpe, Newark, DE (US); Rick W. Ye, Hockessin, DE (US); Quinn Qun Zhu, West Chester, PA (US)

(73) Assignee: E I du Pont de Nemours and Company, Wilmington, DE (US)

( * ) Notice: Subject to any disclaimer, the term of this patent is extended or adjusted under 35 U.S.C. 154(b) by 1807 days.

(21) Appl. No.: 11/952,243

(22) Filed: Dec. 7, 2007

(65) Prior Publication Data

US 2012/0142082 A1    Jun. 7, 2012

Related U.S. Application Data

(60) Provisional application No. 60/869,576, filed on Dec. 12, 2006, provisional application No. 60/869,591, filed on Dec. 12, 2006, provisional application No. 60/869,574, filed on Dec. 12, 2006, provisional application No. 60/869,582, filed on Dec. 12, 2006, provisional application No. 60/869,580, filed on Dec. 12, 2006.

(51) Int. Cl.
| | |
|---|---|
| *C12N 1/19* | (2006.01) |
| *C07C 403/24* | (2006.01) |
| *C12P 7/64* | (2006.01) |
| *C09B 61/00* | (2006.01) |
| *C12P 23/00* | (2006.01) |

(52) U.S. Cl.
CPC .............. *C12P 23/00* (2013.01); *C07C 403/24* (2013.01); *C12P 7/6472* (2013.01); *C12P 7/6427* (2013.01); *C09B 61/00* (2013.01)
USPC ...................................................... 435/254.2

(58) Field of Classification Search
None
See application file for complete search history.

(56) References Cited

U.S. PATENT DOCUMENTS

| | | | |
|---|---|---|---|
| 7,064,196 B2 | 6/2006 | Cheng et al. | |
| 7,238,482 B2 | 7/2007 | Picataggio et al. | |
| 7,851,199 B2 * | 12/2010 | Bailey et al. | 435/254.2 |
| 2004/0268439 A1 * | 12/2004 | Cheng et al. | 800/282 |
| 2005/0043527 A1 * | 2/2005 | Yadav et al. | 536/23.7 |
| 2006/0035351 A1 | 2/2006 | Zhu et al. | |
| 2006/0094092 A1 | 5/2006 | Damude et al. | |
| 2006/0110806 A1 | 5/2006 | Damude et al. | |
| 2006/0115881 A1 | 6/2006 | Damude et al. | |
| 2007/0015237 A1 * | 1/2007 | Bailey et al. | 435/67 |

FOREIGN PATENT DOCUMENTS

| | | |
|---|---|---|
| WO | WO 2004/104180 A2 | 12/2004 |
| WO | WO 2006/102342 A2 | 9/2006 |
| WO | WO 2007/120423 A2 | 10/2007 |
| WO | WO 2008/042338 A2 | 4/2008 |

OTHER PUBLICATIONS

Lee et al in "Metabolic engineering toward biotechnological production of carotenoids in microorganisms" (Appl Microbiol Biotechnol: 2002 vol. 60, pp. 1-11).*
Christiansen et al., Growth and Survival of Atlantic Salmon, Salmo Salar L., FED Different Dietary Levels of Astaxanthin. First-Feeding Fry, Aquaculture Nutrition 1995, vol. 1:189-198.
Blaszczyk et al., Apoptosis and Cytotoxicity Caused by Ethoxyquin and Two of Its Salts, Cell Mol. Biol. Lett., 2005, vol. 10:15-21.
Blaszczyk et al., Induction of Chromosome Aberrations in Cultured Human Lymphocytes Treated With Ethoxyquin, Mutat. Res., 2003, vol. 542:117-128.
A.D. Little, Chemical Evaluation Committee Draft Report, Ethoxyquin, CAS No. 91-53-2 1990.
Cannizzaro et al., Metabolic Network Analysis on Phaffia Rhodozma Yeast Using 13C-Labeled Glucose and Gas Chromatography-Mass Spectrometry, Metabolic Engineering, 2004, vol. 6:340-351.
U.S. Appl. No. 60/971,177, filed Oct. 3, 2007, Zhixiong Xue et al.
Botham, et al., "A Biochemical Explanation for Lipid Accumulation in *Candida* 107 and Other . . .", J. of Gen. Microbiology, vol. 114, pp. 361-375 (1979).
Evans, et al., "Regulation of Citrate Efflux from Mitochondria of Oleaginous and Non-Oleaginous Yeasts . . . ", Eur. J. Biochem., vol. 132, pp. 609-615 (1981).

* cited by examiner

*Primary Examiner* — Catherine Hibbert

(57) ABSTRACT

Engineered strains of the oleaginous yeast *Yarrowia lipolytica* capable of producing carotenoids (e.g., β-carotene, lycopene, lutein, zeaxanthin, canthaxanthin, astaxanthin) are provided. The strains may also be engineered to co-produce at least one ω-3/ω-6 polyunsaturated fatty acid and/or at least one additional antioxidant. Methods of using the carotenoid products obtained (e.g., biomass and/or pigmented oils) in food and feed applications are also provided.

5 Claims, 21 Drawing Sheets

A HPLC analysis of the lycopene content in YL5 strain

B Absorbance spectrum of lycopene produced by YL5 strain

A

CAROTENOID PRODUCTION IN A RECOMBINANT OLEAGINOUS YEAST

This application claims the benefit of U.S. Provisional Applications No. 60/869,576, No. 60/869,591, No. 60/869,574, No. 60/869,582 and No. 60/869,580, each filed Dec. 12, 2006.

FIELD OF THE INVENTION

This invention is in the field of biotechnology. More specifically, this invention pertains to a process of producing carotenoids in oleaginous yeast, pigmented yeast biomass produced by the process, and pigmented oil obtained from the yeast biomass. The carotenoid-producing oleaginous yeast may also be engineered to produce one or more $\omega$-3/$\omega$-6 polyunsaturated fatty acids and/or antioxidants (e.g., coenzyme Q and/or resveratrol).

BACKGROUND OF THE INVENTION

Carotenoids (e.g., lycopene, $\beta$-carotene, zeaxanthin, canthaxanthin and astaxanthin) represent one of the most widely distributed and structurally diverse classes of natural pigments, producing pigment colors of light yellow to orange to deep red color. Eye-catching examples of carotenogenic tissues include carrots, tomatoes, red peppers, and the petals of daffodils and marigolds. Carotenoids are synthesized by all photosynthetic organisms, as well as some bacteria and fungi. These pigments have important functions in photosynthesis, nutrition, and protection against photooxidative damage; as such, they are used today in e.g., food ingredients/colors, animal feed ingredients, pharmaceuticals, cosmetics and as nutritional supplements.

Animals do not have the ability to synthesize carotenoids but must obtain these nutritionally important compounds through their dietary sources. Many animals exhibit an increase in tissue pigmentation when carotenoids are included in their diets, a characteristic often valued by consumers. For example, canthaxanthin and astaxanthin are commonly used in commercial aquaculture industries to pigment shrimp and salmonid fish. It has also been reported that astaxanthin may be a dietary requirement for the growth and survival of some salmonid species (Christiansen et al., *Aquaculture Nutrition*, 1:189-198 (1995)). Similarly, lutein, canthaxanthin and astaxanthin are commonly used as pigments in poultry feeds to increase the pigmentation of chicken skin and egg yolks.

Industrially, only a few carotenoids are used, despite the existence of more than 600 different carotenoids identified in nature. This is largely due to difficulties in production and high associated costs. For example, the predominant source of aquaculture pigments used in the market today are produced synthetically and are sold under such trade names as Carophyll® Red (canthaxanthin; DSM Nutritional Products, Heerlen, NL) and Carophyll® Pink (astaxanthin; DSM Nutritional Products); however, the cost of utilizing the synthetically produced pigments is quite high even though the amount of pigment incorporated into the fishmeal is typically less than 100 ppm.

A further concern associated with the use of synthetically produced carotenoids for feed formulations is the common addition of synthetic antioxidants to act as a preservative and to help protect the pigments from oxidation. Many of these synthetic antioxidants are facing significant questions concerning their safety; for example, many adverse health effects (e.g., carcinogenesis, cytotoxicity, etc.) have been reported with the use of ethoxyquin [6-ethoxy-2,2,4-trimethyl-1H-quinoline] (Blaszczyk et. al., *Cell Mol. Biol. Lett.*, 10 (1):15-21 (2005); Blaszczyk et al., *Mutat. Res.*, 542:117-128 (2003); Little, A. D., Chemical Evaluation Committee Draft Report, *Ethoxyquin, CAS Number* 91-53-2, submitted to National Toxicology Program, Executive Summary of Safety and Toxicity Information, U.S. Department of Health and Human Services, (1990)). As such, there is a need for a source of natural carotenoids that optionally comprise natural antioxidants suitable for their stabilization.

Natural carotenoids can either be obtained by extraction of plant material or by microbial synthesis; but, only a few plants are widely used for commercial carotenoid production and the productivity of carotenoid synthesis in these plants is relatively low. Microbial production of carotenoids is a more attractive production route. Examples of carotenoid-producing microorganisms include: algae (*Haematococcus pluvialis*, sold under the tradename NatuRose™ (Cyanotech Corp., Kailua-Kona, Hi.; *Dunaliella* sp.), yeast (*Phaffia rhodozyma*, recently renamed as *Xanthophyllomyces dendrorhous*; *Thraustochytrium* sp.; *Labyrinthula* sp.; and *Saccharomyces cerevisiae*), and bacteria (*Paracoccus marcusii*, *Bradyrhizobium*, *Rhodobacter* sp., *Brevibacterium*, *Escherichia coli* and *Methylomonas* sp.). Additionally, recombinant production of carotenoids is also possible, since the genes involved in carotenoid biosynthesis are well-known and have been heterologously expressed in a variety of host cells (e.g., *E. coli*, *Candida utilis*, *Saccharomyces cerevisiae*, *Methylomonas* sp.). Thus far, few of these demonstrations are suitable to produce a carotenoid product in significant quantities in a cost-effective manner for industrial use.

Many commercial products are formulated to contain a mixture of pigments and fats/lipids and/or natural antioxidants. For example, animal feeds, dietary supplements, and personal care products are often formulated to contain carotenoids, polyunsaturated fatty acids (PUFAs) and antioxidants (e.g., $CoQ_{10}$). For fish feed formulations, fish oil is often supplemented to the feed to provide the necessary caloric intake and to provide essential fatty acids such as the $\omega$-3/$\omega$-6 PUFAs. Typically, for example, a commercial product formulator will obtain these compounds from a variety of sources and formulate them into a final product that contains an effective amount of each ingredient. The composition, purity and source of each ingredient may vary, resulting in a final product formulation that may require significant monitoring and/or processing to obtain the desired product specifications.

Engineering a microorganism to simultaneously produce carotenoids and fats/lipids and/or an additional antioxidant could create a higher value product and prove advantageous for commercial production economics (and therefore availability) to consumers. One class of organisms that are especially suitable as a production platform for synthesis of pigmented microbial oils (optionally comprising PUFAs and/or additional antioxidants) are the oleaginous yeast. Oleaginous yeast are defined as those yeast that are naturally capable of oil synthesis and accumulation, wherein oil accumulation is at least 25% of the cellular dry weight. In particular, *Yarrowia lipolytica* is an oleaginous yeast that has a number of characteristics that make it particularly useful for the production of $\omega$-3/$\omega$-6 PUFAs (see for example commonly owned U.S. Pat. No. 7,238,482 and U.S. patent application Ser. No. 11/198,975, Ser. No. 11/265,761, Ser. No. 11/264,784 and Ser. No. 11/264,737, corresponding to PCT Publication Nos. WO 2006/033723, WO 2006/052870, WO 2006/055322 and WO 2006/052871, respectively; see also U.S. Patent Application No. 60/977,177).

PCT Publication No. WO 2006/102342 (Microbia, Inc.) has engineered an oleaginous yeast to produce carotenoids, thereby resulting in a pigmented microbial product. In particular, they demonstrated greater than 4 mg carotene per gram dry cell weight in *Yarrowia lipolytica* (see Example 2 therein). However, there have been no previous reports of an oleaginous microbial host cell that can co-produce carotenoids and ω-3/ω-6 PUFAs, to thereby result in a single product comprising both ingredients. This is particularly attractive when the recombinant cell biomass is used directly in the formulation (e.g., as an animal feed).

The problem to be solved therefore, is to provide a recombinant oleaginous yeast capable of producing at least one carotenoid. A further problem to be solved is to provide an oleaginous yeast capable of producing at least one carotenoid in combination with an ω-3/ω-6 PUFA and/or at least one additional antioxidant.

SUMMARY OF THE INVENTION

The stated problem has been solved by providing a recombinant oleaginous yeast capable of producing at least one carotenoid. In a preferred embodiment, the carotenoid is selected from the group consisting of lycopene, α-carotene, zeaxanthin, lutein, canthaxanthin and astaxanthin. In another preferred embodiment, the carotenoid is astaxanthin.

Accordingly the invention provides a recombinant oleaginous yeast production host for the production of astaxanthin comprising:
  a.) at least one copy of a crtE gene encoding a geranyl pyrophosphate synthase;
  b.) at least one copy of a crtB gene encoding a phytoene synthase;
  c.) at least one copy of a crtI gene encoding a phytoene desaturase;
  d.) at least one copy of a crtY gene encoding a lycopene cyclase;
  e.) at least one copy of a crtZ gene encoding a carotenoid hydroxylase; and,
  f.) at least one copy of a crtW gene encoding a carotenoid ketolase;
wherein said oleaginous yeast produces at least about 25 weight percent (wt %) of its dry cell weight as oil.

In another embodiment the invention provides a method to produce a pigmented oleaginous yeast biomass comprising a carotenoid compound, comprising:
  a.) providing the recombinant production host of claim 1 wherein said production host accumulates at least 25 wt % of its dry cell weight as oil; and,
  b.) culturing the recombinant production host under suitable conditions whereby pigmented oleaginous yeast biomass comprising a carotenoid compound is produced.

In another embodiment the invention provides a method to produce pigmented oleaginous yeast biomass comprising a recombinant oleaginous yeast which accumulates at least 25 wt % of its dry cell weight as oil and produces a carotenoid compound selected from the group consisting of astaxanthin, β-carotene, lycopene, lutein, zeaxanthin and canthaxanthin.

In another embodiment the invention provides a method to produce pigmented oil comprising:
  a.) an ω-6 polyunsaturated fatty acid or an ω-3 polyunsaturated fatty acid; and,
  b.) a carotenoid compound selected from the group consisting of astaxanthin, β-carotene, lycopene, lutein, zeaxanthin and canthaxanthin.

In another embodiment the invention provides a pigmentation product comprising:
  a.) the pigmented oleaginous yeast biomass of claim 11;
  b.) the pigmented oil of claim 10; or,
  c.) mixtures thereof.

In another embodiment the invention provides a method to produce a recombinant oleaginous yeast cell having at least about 25 wt % of its dry cell weight as oil and which accumulates a carotenoid compound selected from the group consisting of: astaxanthin, β-carotene, lycopene, lutein, zeaxanthin and canthaxanthin.

In another embodiment the invention provides a method of pigmenting an animal comprising the steps of:
  a.) providing a pigmented animal feed comprising an effective amount of astaxanthin and an effective amount of a microbially-produced oil; and,
  b.) feeding an animal the pigmented animal feed of step (a) whereby at least one tissue in said animal or a product produced by said animal, is pigmented.

BRIEF DESCRIPTION OF THE BIOLOGICAL DEPOSITS, FIGURES, AND SEQUENCE DESCRIPTIONS

The invention can be more fully understood from the following biological deposits, figures, sequence descriptions, and the detailed description.

BIOLOGICAL DEPOSITS

The following biological materials were made under the terms of the Budapest Treaty on the International Recognition of the Deposit of Microorganisms for the Purposes of Patent Procedure:

| Biological Material | Accession Number | Date of Deposit |
| --- | --- | --- |
| *Yarrowia lipolytica* Y2047 | ATCC PTA-7186 | Oct. 26, 2005 |
| *Yarrowia lipolytica* Y2201 | ATCC PTA-7185 | Oct. 26, 2005 |
| *Yarrowia lipolytica* Y2096 | ATCC PTA-7184 | Oct. 26, 2005 |
| *Yarrowia lipolytica* Y3000 | ATCC PTA-7187 | Oct. 26, 2005 |
| *Yarrowia lipolytica* Y4128 | ATCC PTA-8614 | Aug. 23, 2007 |
| *Yarrowia lipolytica* Y4127 | ATCC PTA-____ | Nov. X, 2007 |

As used herein, "ATCC" refers to the American Type Culture Collection International Depository Authority located at ATCC, 10801 University Blvd., Manassas, Va. 20110-2209, U.S.A. The listed deposit will be maintained in the indicated international depository for at least 30 years and will be made available to the public upon the grant of a patent disclosing it. The availability of a deposit does not constitute a license to practice the subject invention in derogation of patent rights granted by government action.

BRIEF DESCRIPTION OF THE BIOLOGICAL SEQUENCES

Figure 1:
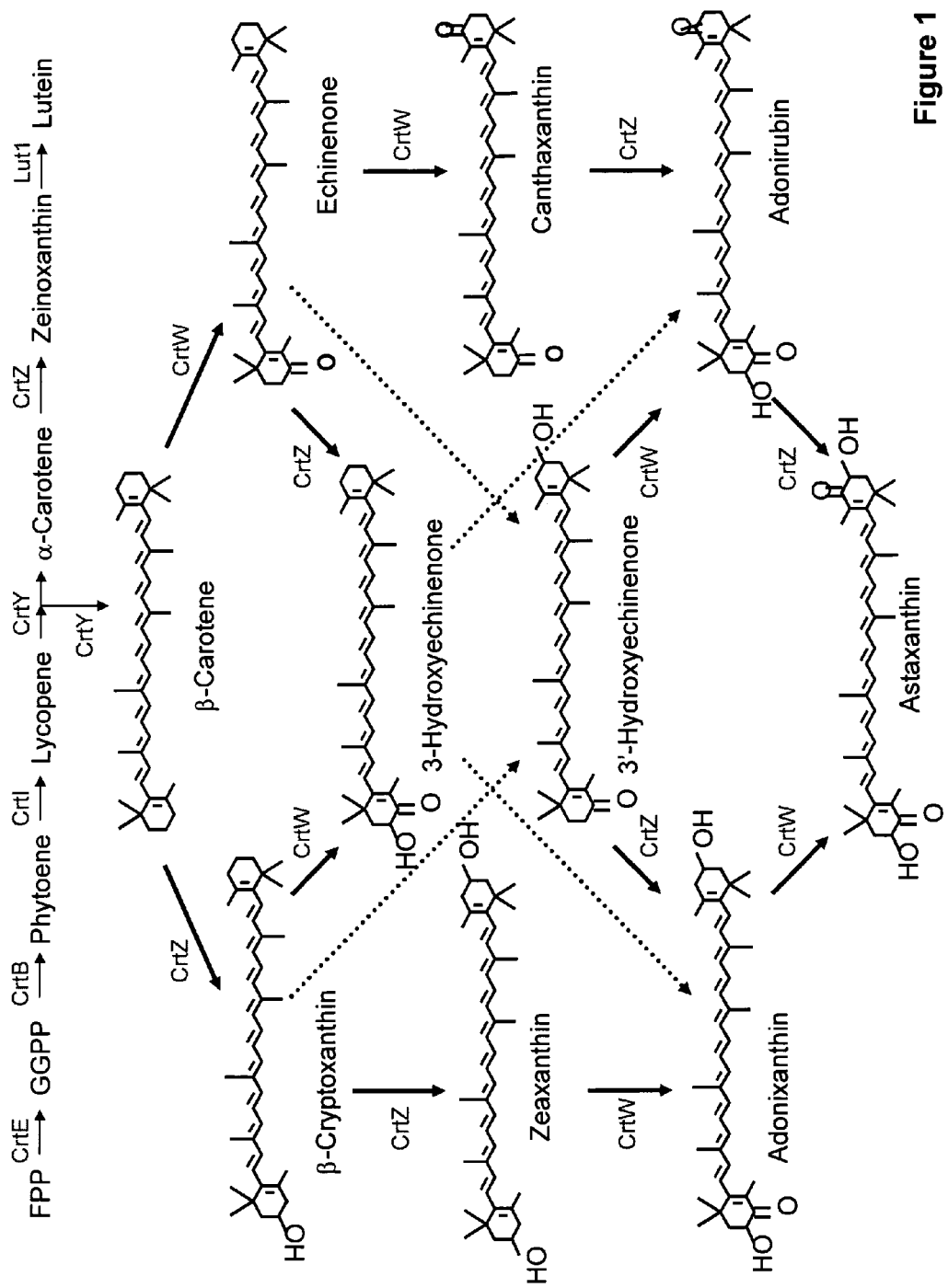
FIG. 1 illustrates the carotenoid biosynthetic pathway from farnesyl pyrophosphate (FPP) to astaxanthin.

The following sequences comply with 37 C.F.R. §1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST. 25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

TABLE 1

Summary Of Nucleic Acid And Protein SEQ ID Numbers

| Description and Abbreviation | Nucleic acid SEQ ID NO. | Protein SEQ ID NO. |
|---|---|---|
| *Yarrowia lipolytica* gene encoding a mutant acetohydroxyacid synthase (AHAS) comprising a W497L mutation (CDS corresponds to bases 146-2556, with a 461 bp intron between bases 268-732) | 1 (2987 bp) | — |
| Synthetic geranylgeranyl pyrophosphate synthase derived from *Pantoea stewartii* DC413, codon-optimized for expression in *Yarrowia lipolytica* ("crtE$_{syn}$") | 2 (911 bp) | 3 (302 AA) |
| Synthetic phytoene synthase derived from *Pantoea stewartii* DC413, codon-optimized for expression in *Yarrowia lipolytica* ("crtB$_{syn}$") | 4 (936 bp) | 5 (309 AA) |
| Synthetic phytoene desaturase gene derived from *Pantoea stewartii* DC413, codon-optimized for expression in *Yarrowia lipolytica* ("crtI$_{syn}$") | 6 (1484 bp) | 7 (493 AA) |

TABLE 1-continued

Summary Of Nucleic Acid And Protein SEQ ID Numbers

| Description and Abbreviation | Nucleic acid SEQ ID NO. | Protein SEQ ID NO. |
|---|---|---|
| Plasmid pZKleuN-6EP | 8 (11,337 bp) | — |
| *Escherichia coli* LoxP recombination site, recognized by a Cre recombinase enzyme | 9 (34 bp) | — |
| Plasmid pEXPGUS1-P | 10 (6874 bp) | — |
| Plasmid pZP34R | 11 (11,444 bp) | — |
| Plasmid pYCRTEBI | 12 (13,489 bp) | — |
| Plasmid pY79 | 13 (8982 bp) | — |
| Plasmid pZKSL555 | 14 (14,256 bp) | — |
| Plasmid pDCQ392 | 15 (12,210 bp) | — |
| *Brevundimonas vesicularis* DC263 β-carotene ketolase ("crtW$_{392}$") | 16 (780 bp) | 17 (259 AA) |
| *Brevundimonas vesicularis* DC263 β-carotene hydroxylase ("crtZ$_{392}$") | 18 (486 bp) | 19 (161 AA) |
| *Pantoea stewartii* DC413 lycopene cyclase ("crtY$_{392}$") | 20 (1161 bp) | 21 (387 AA) |
| Plasmid pYPS106 | 30 (14,079 bp) | — |
| Plasmid pYPS107 | 33 (13,239 bp) | — |
| Plasmid pYPS108 | 36 (12,681 bp) | — |
| Synthetic lycopene cyclase derived from *Pantoea stewartii* DC413, codon-optimized for expression in *Yarrowia lipolytica* ("crtY392$_{syn}$") | 37 (1161 bp) | 38 (387 AA) |
| Synthetic β-carotene ketolase derived from *Brevundimonas vesicularis* DC263, codon-optimized for expression in *Yarrowia lipolytica* ("crtW392$_{syn}$") | 39 (780 bp) | 40 (259 AA) |
| Synthetic β-carotene hydroxylase derived from *Brevundimonas vesicularis* DC263, codon-optimized for expression in *Yarrowia lipolytica* ("crtZ392$_{syn}$") | 41 (486 bp) | 42 (161 AA) |
| Plasmid pYPS127 | 43 (8252 bp) | — |
| Plasmid pYPS128 | 44 (7958 bp) | — |
| Plasmid pZKLeuN-29E3 | 45 (14,688 bp) | — |
| *Fusarium moniliforme* Δ12 desaturase ("FmD12") | 46 (1434 bp) | 47 (477 AA) |
| *Euglena gracilis* Δ9 elongase ("EgD9e") | 48 (777 bp) | 49 (258 AA) |
| Synthetic Δ9 elongase derived from *Euglena gracilis*, codon-optimized for expression in *Yarrowia lipolytica* ("EgD9eS") | 50 (777 bp) | 51 (258 AA) |
| Synthetic C$_{16/18}$ elongase derived from *Mortierella alpina* ELO3, codon-optimized for expression in *Yarrowia lipolytica* ("ME3S") | 52 (828 bp) | 53 (275 AA) |
| Plasmid pY116 | 54 (8739 bp) | — |
| Plasmid pKO2UF8289 | 55 (15,337 bp) | — |
| *Yarrowia lipolytica* Δ12 desaturase ("YID12") | 56 (1936 bp) | 57 (419 AA) |
| Synthetic mutant Δ8 desaturase ("EgD8M"; U.S. Patent Application No. 11/635,258), derived from *Euglena gracilis* ("EgD8S"; PCT Publication No. WO 2006/012326) | 58 (1272 bp) | 59 (422 AA) |
| Synthetic Δ8 desaturase derived from *Euglena gracilis*, codon-optimized for expression in *Yarrowia lipolytica* ("D8SF" or "EgD8S") | 60 (1272 bp) | 61 (422 AA) |
| Plasmid pZKSL-555R | 62 (13,707 bp) | — |

TABLE 1-continued

Summary Of Nucleic Acid And Protein SEQ ID Numbers

| Description and Abbreviation | Nucleic acid SEQ ID NO. | Protein SEQ ID NO. |
|---|---|---|
| Synthetic Δ5 desaturase derived from *Euglena gracilis* (U.S. Patent Application No., 11/748,629) codon-optimized for expression in *Yarrowia lipolytica* ("EgD5S") | 63 (1350 bp) | 64 (449 AA) |
| Synthetic Δ5 desaturase derived from *Peridinium* sp. CCMP626 (U.S. Patent Application No. 11/748,637), codon-optimized for expression in *Yarrowia lipolytica* ("RD5S") | 65 (1392 bp) | 66 (463 AA) |
| *Euglena gracilis* Δ5 desaturase (U.S. Patent Application No. 11/748,629) ("EgD5") | 67 (1350 bp) | 68 (449 AA) |
| Plasmid pZP3-Pa777U | 69 (13,066 bp) | — |
| Synthetic Δ17 desaturase derived from *Pythium aphanidermatum*, codon-optimized for expression in *Yarrowia lipolytica* (U.S. Patent Application No. 11/779,915) ("PaD17S") | 70 (1080 bp) | 71 (359 AA) |
| *Pythium aphanidermatum* Δ17 desaturase (U.S. Patent Application No. 11/779,915) ("PaD17") | 72 (1080 bp) | 73 (359 AA) |
| Plasmid pY117 | 74 (9570 bp) | — |
| Plasmid pZP2-2988 | 75 (15,743 bp) | — |
| Synthetic Δ12 desaturase derived from *Fusarium moniliforme*, codon-optimized for expression in *Yarrowia lipolytica* ("FmD12S") | 76 (1434 bp) | 77 (477 AA) |
| Plasmid pZKUE3S | 78 (6303 bp) | — |
| Plasmid pZKL1-2SP98C | 79 (15,877 bp) | — |
| *Yarrowia lipolytica* diacylglycerol cholinephosphotransferase gene ("YlCPT1") | 80 (1185 bp) | 81 (394 AA) |
| Plasmid pZKL2-5U89GC | 82 (15,812 bp) | — |
| Synthetic lycopene cyclase derived from *Enterobacteriaceae* DC260, codon-optimized for expression in *Yarrowia lipolytica* ("crtY343$_{syn}$") | 83 (1164 bp) | 84 (388 AA) |
| Synthetic lycopene cyclase derived from *Pantoea agglomerans* DC404, codon-optimized for expression in *Yarrowia lipolytica* ("crtY334$_{syn}$") | 85 (1167 bp) | 86 (389 AA) |
| Synthetic β-carotene ketolase derived from *Sphingomonas melonis* DC18, codon-optimized for expression in *Yarrowia lipolytica* ("crtW341$_{syn}$") | 87 (744 bp) | 88 (248 AA) |
| Synthetic β-carotene ketolase derived from *Agrobacterium aurantiacum*, codon-optimized for expression in *Yarrowia lipolytica* ("crtW333$_{syn}$") | 89 (726 bp) | 90 (242 AA) |
| Synthetic β-carotene hydroxylase derived from *Brevundimonas vesicularis* DC263, codon-optimized for expression in *Yarrowia lipolytica* ("crtZ343$_{syn}$") | 91 (486 bp) | 92 (161 AA) |
| Synthetic β-carotene hydroxylase derived from *Agrobacterium aurantiacum*, codon-optimized for expression in *Yarrowia lipolytica* ("crtZ334$_{syn}$") | 93 (486 bp) | 94 (162 AA) |
| Plasmid pYPS147 | 95 (13,625 bp) | — |
| Plasmid pYPS162 | 96 (12,829 bp) | — |
| Plasmid pYPS152 | 97 (12,380 bp) | — |
| Plasmid pZKUM | 98 (4313 bp) | — |
| Synthetic mutant Ura3 gene comprising a 33 bp deletion from +21 to +53, a 1 bp deletion at +376 and a 3 bp deletion from +400 to +403 of the *Yarrowia* Ura3 coding region (GenBank Accession No. AJ306421) | 99 (1459 bp) | — |

SEQ ID NOs:22 and 23 correspond to the forward and reverse primers, respectively, used to PCR amplify crtY$_{392}$ from the DCQ392 carotenoid gene cluster.

SEQ ID NOs:24 and 25 correspond to the forward and reverse primers, respectively, used to PCR amplify crtZ$_{392}$ from the DCQ392 carotenoid gene cluster.

SEQ ID NOs:26 and 27 correspond to the forward and reverse primers, respectively, used to PCR amplify crtW$_{392}$ from the DCQ392 carotenoid gene cluster.

SEQ ID NOs:28 and 29 are the nucleotide sequences of the Exp-forward primer and HY-339 reverse primer, respectively, used to verify construction of plasmid pYPS106.

SEQ ID NOs:31 and 32 are the nucleotide sequences of the NT forward primer and the Lip1-3' reverse primer, respectively, used to verify construction of plasmid pYPS107.

SEQ ID NOs:34 and 35 are the nucleotide sequences of the GPAT forward primer and the Pex20 reverse primer, respectively, used to verify construction of plasmid pYPS108.

DETAILED DESCRIPTION OF THE INVENTION

The following patents, patent applications, and publications may be referred to for the interpretation of the specification and the claims. This includes the following commonly owned patent applications and/or patents relating to carotenoids: U.S. Pat. No. 6,929,928; U.S. Pat. No. 7,064,196; U.S. Pat. No. 7,091,031; U.S. Pat. No. 7,217,537; U.S. Pat. No. 7,232,666; U.S. Pat. No. 7,252,985; U.S. Pat. No. 7,288,387; U.S. patent application Ser. No. 11/230,161 (filed Sep. 19, 2005).

This also includes the following commonly owned patent applications relating to antioxidants in oleaginous yeast: U.S. patent application Ser. No. 11/436,182 (filed May 17, 2006) and U.S. Patent Application No. 60/991,266 (filed Nov. 30, 2007).

Similarly, this specifically includes the following commonly owned and co-pending patent applications and/or patents related to polyunsaturated fatty acids and oleaginous yeast: U.S. Pat. No. 7,125,672, U.S. Pat. No. 7,189,559, U.S. Pat. No. 7,192,762, U.S. Pat. No. 7,198,937, U.S. Pat. No. 7,202,356, U.S. Pat. No. 7,214,491, U.S. Pat. No. 7,238,482, U.S. Pat. No. 7,256,033, U.S. Pat. No. 7,259,255, U.S. Pat. No. 7,264,949, U.S. Pat. No. 7,267,976, U.S. patent application Ser. No. 10/985,254 and Ser. No. 10/985,691, U.S. patent application Ser. No. 11/024,544, U.S. patent application Ser. No. 11/183,664, U.S. patent application Ser. No. 11/185,301, U.S. patent application Ser. No. 11/190,750, U.S. patent application Ser. No. 11/198,975, U.S. patent application Ser. No. 11/253,882, U.S. patent application Ser. No. 11/264,784 and Ser. No. 11/264,737, U.S. patent application Ser. No. 11/265,761, U.S. patent application Ser. No. 11/601,563 and Ser. No. 11/601,564, U.S. patent application Ser. No. 11/635,258, U.S. patent application Ser. No. 11/613,420, U.S. patent application Ser. No. 11/787,772, U.S. patent application Ser. No. 11/737,772, U.S. patent application Ser. No. 11/740,298, U.S. patent application Ser. No. 11/748,629 and Ser. No. 11/748,637, and U.S. patent application Ser. No. 11/779,915.

The invention provides a recombinant oleaginous yeast production host for the production of $C_{40}$ carotenoids, wherein said host comprises at least one crtE gene, at least one crtB gene, at least one crtI gene, and optionally at least one additional gene selected from the group consisting of: crtY, crtW, crtZ and lut1; wherein expression of the enzyme(s) results in the production of $C_{40}$ carotenoids (e.g., lycopene, β-carotene, lutein, zeaxanthin, canthaxanthin and astaxanthin). In additional embodiments, the recombinant oleaginous yeast production host can co-produce $C_{40}$ carotenoids and at least one ω-3/ω-6 PUFA (e.g., linoleic acid, γ-linolenic acid, eicosadienoic acid, dihomo-γ linolenic acid, arachidonic acid, α-linolenic acid, stearidonic acid, eicosatrienoic acid, eicosatetraenoic acid, eicosapentaenoic acid, docosapentaenoic acid, docosahexaenoic acid) and/or at least one antioxidant (e.g., coenzyme $Q_6$, coenzyme $Q_7$, coenzyme $Q_8$, coenzyme $Q_9$, coenzyme $Q_{10}$, resevatrol).

In all of the above aspects of the present invention, a recombinant oleaginous yeast is used as the production platform. In a preferred aspect, the oleaginous yeast host cell is *Yarrowia lipolytica*.

DEFINITIONS

In this disclosure, a number of terms and abbreviations are used. The following definitions are provided.

"Open reading frame" is abbreviated ORF.
"Polymerase chain reaction" is abbreviated PCR.
"American Type Culture Collection" is abbreviated ATCC.
"Isopentenyl pyrophosphate" is abbreviated IPP.
"Geranyl pyrophosphate" is abbreviated GPP.
"Farnesyl pyrophosphate" is abbreviated FPP.
"Polyunsaturated fatty acid(s)" is abbreviated PUFA(s).
"Triacylglycerols" are abbreviated TAGs.
"Coenzyme Q" is abbreviated CoQ.
"Weight percent" is abbreviated wt %.
"Dry cell weight" is abbreviated dcw.

The term "invention" or "present invention" as used herein is not meant to be limiting to any one specific embodiment of the invention but applies generally to any and all embodiments of the invention as described in the claims and specification.

As used herein, the term "comprising" means the presence of the stated features, integers, steps, or components as referred to in the claims, but it does not preclude the presence or addition of one or more other features, integers, steps, components or groups thereof.

As used herein, the term "about" modifying the quantity of an ingredient or reactant of the invention employed refers to variation in the numerical quantity that can occur, for example, through: typical measuring and liquid handling procedures used for making concentrates or use solutions in the real world; inadvertent error in these procedures; differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one aspect, the term "about" means within 20% of the recited numerical value, preferably within 10%, and most preferably within 5%.

A metabolic pathway, or biosynthetic pathway, in a biochemical sense, can be regarded as a series of chemical reactions occurring within a cell, catalyzed by enzymes, to achieve either the formation of a metabolic product to be used or stored by the cell, or the initiation of another metabolic pathway (then called a flux generating step). Many of these pathways are elaborate, and involve a step by step modification of the initial substance to shape it into a product having the exact chemical structure desired. The subject application describes carotenoid biosynthetic pathways, PUFA biosynthetic pathways and specific antioxidant pathways.

The term "isoprenoid compound" refers to compounds formally derived from isoprene (2-methylbuta-1,3-diene; $CH_2$=$C(CH_3)CH$=$CH_2$), the skeleton of which can generally be discerned in repeated occurrence in the molecule. These compounds are produced biosynthetically via the isoprenoid pathway beginning with isopentenyl pyrophosphate (IPP) and formed by the head-to-tail condensation of isoprene units, leading to molecules which may be, for example, of 5, 10, 15, 20, 30, or 40 carbons in length.

As used herein, the term "carotenoid" refers to a class of hydrocarbons having a conjugated polyene carbon skeleton formally derived from isoprene. This class of molecules is composed of triterpenes ($C_{30}$ diapocarotenoids) and tetraterpenes ($C_{40}$ carotenoids) and their oxygenated derivatives; and, these molecules typically have strong light absorbing properties and may range in length in excess of $C_{200}$. Such carotenoids react destructively with oxygen and hence may require additional antioxidant compounds to act as preservatives. Other "carotenoid compounds" are known which are $C_{35}$, $C_{50}$, $C_{60}$, $C_{70}$ and $C_{80}$ in length, for example.

All "tetraterpenes" or "$C_{40}$ carotenoids" consist of eight isoprenoid units joined in such a manner that the arrangement of isoprenoid units is reversed at the center of the molecule so that the two central methyl groups are in a 1,6-positional relationship and the remaining nonterminal methyl groups are in a 1,5-positional relationship. All $C_{40}$ carotenoids may be formally derived from the acyclic $C_{40}H_{56}$ structure, having a long central chain of conjugated double bonds that is subjected to various functionalizations.

The term "functionalized" or "functionalization" refers to the (i) hydrogenation, (ii) dehydrogenation, (iii) cyclization, (iv) oxidation, or (v) esterification/glycosylation of any portion of the carotenoid backbone. This backbone is defined as the long central chain of conjugated double bonds. Functionalization may also occur by any combination of the above processes, to thereby result in creation of an acyclic carotenoid or a cartenoid terminated with one (monocyclic) or two (bicyclic) cyclic end groups. Additionally, some carotenoids arise from rearrangements of the carbon skeleton, or by the (formal) removal of part of the backbone structure.

The term "carotenoid" may include both carotenes and xanthophylls. A "carotene" refers to a hydrocarbon carotenoid (e.g., phytoene, β-carotene and lycopene). In contrast, the term "xanthophyll" refers to a $C_{40}$ carotenoid that contains one or more oxygen atoms in the form of hydroxy-, methoxy-, oxo-, epoxy-, carboxy-, or aldehydic functional groups. Examples of xanthophylls include, but are not limited to antheraxanthin, adonixanthin, astaxanthin (i.e., 3,3'-dihydroxy-β,β-carotene-4,4'-dione), canthaxanthin (i.e., β,β-carotene-4,4'-dione), β-cryptoxanthin, keto-γ-carotene, echinenone, 3-hydroxyechinenone, 3'-hydroxyechinenone, zeaxanthin, adonirubin, tetrahydroxy-β,β'-caroten-4,4'-dione, tetrahydroxy-β,β'-caroten-4-one, caloxanthin, erythroxanthin, nostoxanthin, flexixanthin, 3-hydroxy-γ-carotene, 3-hydroxy-4-keto-γ-carotene, bacteriorubixanthin, bacteriorubixanthinal and lutein. Xanthophylls are more polar than carotenes and this property dramatically reduces their solubility in fats and lipids.

As used herein, the terms "carotenoid biosynthetic pathway" and "carotenoid pathway" will be used interchangeably and refer to those enzymes which convert farnesyl pyrophosphate (FPP) to a suite of carotenoids. These include those genes and gene products that are involved in the immediate synthesis of phytoene (whose synthesis represents the first step unique to biosynthesis of $C_{40}$ carotenoids). All subsequent reactions leading to the production of various $C_{40}$ carotenoids are included within the carotenoid biosynthetic pathway. These genes and gene products comprise all of the "at" genes including, but not limited to: crtE, crtX, crtY, crtI, crtB, crtZ, crtW, crtO, crtA, crtC, crtD, crtF and crtU, as well as the lut1 gene. Finally, the term "carotenoid biosynthetic enzyme" is an inclusive term referring to any and all of the enzymes in the carotenoid pathway including, but not limited to: CrtE, CrtX, CrtY, CrtI, CrtB, CrtZ, CrtW, CrtO, CrtA, CrtC, CrtD, CrtF, CrtU and Lut1.

As used herein, the term "functional" in context with the carotenoid biosynthetic pathway means that some (or all of) the genes in the pathway express active enzymes, resulting in in vivo catalysis or substrate conversion that results in production of at least one carotenoid. It should be understood that "carotenoid biosynthetic pathway" or "functional carotenoid biosynthetic pathway" does not imply that all the genes listed in the above paragraph are required, as a number of carotenoid products will only require the expression of a subset of the genes of this pathway.

The term "CrtE" refers to a geranylgeranyl pyrophosphate synthase enzyme encoded by the crtE gene and which converts trans-trans-farnesyl diphosphate and IPP to pyrophosphate and geranylgeranyl diphosphate.

The term "CrtB" refers to a phytoene synthase enzyme encoded by the crtB gene which catalyzes the reaction from prephytoene diphosphate to phytoene.

The term "CrtI" refers to a phytoene desaturase enzyme encoded by the crtI gene. CrtI converts phytoene into lycopene via the intermediaries of phytofluene, ζ-carotene and neurosporene by the introduction of 4 double bonds.

The term "CrtY" refers to a lycopene cyclase enzyme encoded by the crtY gene that converts lycopene to β-carotene.

The term "CrtZ" refers to a carotenoid hydroxylase enzyme (also referred to herein as a "β-carotene hydroxylase") encoded by the crtZ gene that catalyzes a hydroxylation reaction. The oxidation reaction adds a hydroxyl group to cyclic carotenoids having a β-ionone type ring. It is known that CrtZ hydroxylases typically exhibit substrate flexibility, enabling production of a variety of hydroxylated carotenoids depending upon the available substrates; for example, CrtZ catalyzes the hydroxylation reaction from β-carotene to zeaxanthin.

The term "CrtX" refers to a zeaxanthin glucosyl transferase enzyme encoded by the crtX gene and which converts zeaxanthin to zeaxanthin-β-diglucoside.

The term "CrtW" refers to a β-carotene ketolase (also referred to herein as a "carotenoid ketolase") enzyme encoded by the crtW gene that catalyzes an oxidation reaction where a keto group is introduced on the β-ionone type ring of cyclic carotenoids. This reaction converts cyclic carotenoids, such as β-carotene or zeaxanthin, into the ketocarotenoids canthaxanthin or astaxanthin, respectively. Intermediates in the process typically include echinenone and adonixanthin. It is known that CrtW ketolases typically exhibit substrate flexibility, enabling production of a variety of ketocarotenoids depending upon the available substrates.

The term "CrtO" refers to a β-carotene ketolase (also referred to herein as a "carotenoid ketolase") enzyme encoded by the crtO gene that catalyzes an oxidation reaction where a keto group is introduced on the β-ionone type ring of cyclic carotenoids. The CrtO-type carotenoid ketolases are structurally unrelated to the CrtW-type ketolases, despite behaving with similar functionality and substrate flexibility as that of the CrtW-type ketolases (supra). In one aspect, a mixture of CrtW-type and CrtO-type carotenoid ketolases may be used to produce the desired ketocarotenoids.

The term "Lut1" refers to a ε-hydroxylase enzyme encoded by the lut1 gene that catalyzes ε-ring hydroxylation. LUT1 defines a class of carotenoid hydroxylases that has evolved independently from and uses a different mechanism than nonheme diiron β-carotene hydroxylases (Tian, Li et al., *Proc. Natl. Acad. Sci. U.S.A.*, 101 (1):402-407 (2004)).

"Pigment" refers to a substance used for coloring another material. With respect to the present invention, the pigments described herein are carotenoids produced by a recombinant oleaginous yeast. These caretenoids can be used for coloring, for example, animal tissues (e.g., shrimp, salmonid fish, chicken skin, egg yolks).

"Antioxidants" are described simplistically as compounds (e.g., enzymes, organic molecules) that slow the rate of oxidation reactions or that can counteract the damaging effects of oxygen. Although the term technically applies to molecules reacting with oxygen, it is often applied to molecules that protect from any free radical (i.e., a molecule with an unpaired electron, such as hydroxyl radicals, lipid oxyl or peroxyl radicals, singlet oxygen, and peroxinitrite formed from nitrogen oxide (NO)). Free radicals are natural by-products of cellular processes in an organism or are created by exposure to environmental factors. Within cellular organisms, free radicals can cause cellular and tissue damage, which can ultimately lead to disease. Antioxidants neutralize free radicals by donating one of their own electrons to the free radical, since the radicalized antioxidant molecule is more stable as a free-radical than the original free-radical.

As used herein, "coenzyme Q" or "CoQ" and "ubiquinone" will be used interchangeably and will generically refer to a series of lipophilic redox-active molecules comprised of a redox active quinone structure (CAS Registry No. 1339-63-5), including $CoQ_6$, $CoQ_7$, $CoQ_8$, $CoQ_9$ and $CoQ_{10}$. In its reduced state, coenzyme Q acts as an antioxidant; in its oxidized state, it can undergo a redox cycle in the presence of an electron donor and oxygen such that the electron donor is oxidized, the oxygen is reduced and the CoQ is available to undergo another redox cycle. The compound occurs in the majority of aerobic organisms, from bacteria to higher plants and animals.

The term coenzyme $Q_{10}$ ("$CoQ_{10}$") refers to 2,3-dimethoxy-dimethyl-6-decaprenyl-1,4-benzoquinone, also known as ubiquinone-10 (CAS Registry No. 303-98-0). This coenzyme has a hydrocarbon tail that is 50 carbon atoms in length, comprised of ten 5-carbon isoprene units. Synthesis of $CoQ_{10}$ requires a prenyl diphosphate synthase, known as decaprenyl diphosphate synthase (DecPP; catalyzing a $C_{16} \rightarrow C_{50}$ reaction). Means to genetically engineer production of $CoQ_{10}$ in oleaginous yeast is described in U.S. Provisional Patent Application No. 60/991,266.

The term coenzyme $Q_9$ ("$CoQ_9$") refers to ubiquinone-9. This coenzyme has a hydrocarbon tail that is 45 carbon atoms in length, comprised of nine 5-carbon isoprene units. Synthesis of $CoQ_9$ requires a prenyl diphosphate synthase, known as solanesyl [or nonaprenyl] diphosphate synthase (SPP or NonPP; catalyzing a $C_{15} \rightarrow C_{45}$ reaction). Many oleaginous yeast, such as *Yarrowia lipolytica*, natural produce significant concentrations of the $CoQ_9$ antioxidant (at least about 2000 ppm).

As used herein, the term "resveratrol" is used to describe the compound trans-3,4',5-trihydroxystilbene. Synthesis of this potent antioxidant in oleaginous yeast is described in PCT Publication No. WO 2006/125000.

"Microbial oils" or "single cell oils" are those oils naturally produced by microorganisms (e.g., algae, oleaginous yeasts and filamentous fungi) during their lifespan. As used herein, the term "oil" refers to a lipid substance that is liquid at 25° C. and usually polyunsaturated. In contrast, the term "fat" refers to a lipid substance that is solid at 25° C. and usually saturated.

"Lipid bodies" refer to lipid droplets that usually are bounded by specific proteins and a monolayer of phospholipid. These organelles are sites where most organisms transport/store neutral lipids. Lipid bodies are thought to arise from microdomains of the endoplasmic reticulum that contain TAG-biosynthesis enzymes and, their synthesis and size appear to be controlled by specific protein components.

"Neutral lipids" refer to those lipids commonly found in cells in lipid bodies as storage fats and oils and are so called because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or TAG, respectively (or collectively, acylglycerols). A hydrolysis reaction must occur to release free fatty acids from acylglycerols.

The term "fatty acids" refers to long chain aliphatic acids (alkanoic acids) of varying chain lengths, from about $C_{12}$ to $C_{22}$ (although both longer and shorter chain-length acids are known). The predominant chain lengths are between $C_{16}$ and $C_{22}$. The structure of a fatty acid is represented by a simple notation system of "X:Y", where X is the total number of carbon (C) atoms in the particular fatty acid and Y is the number of double bonds. Additional details concerning the differentiation between "saturated fatty acids" versus "unsaturated fatty acids", "monounsaturated fatty acids" versus "polyunsaturated fatty acids" (or "PUFAs"), and "omega-6 fatty acids" (ω-6 or n-6) versus "omega-3 fatty acids" (ω-3 or n-3) are provided in U.S. Pat. No. 7,238,482.

The term "oleaginous" refers to those organisms that tend to store their energy source in the form of lipid (Weete, In: Fungal Lipid Biochemistry, $2^{nd}$ Ed., Plenum, 1980). The term "oleaginous yeast" refers to those microorganisms classified as yeasts that can make oil. Generally, the cellular oil or TAG content of oleaginous microorganisms follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.*, 57:419-25 (1991)). It is not uncommon for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces*.

As used herein the term "biomass" refers specifically to spent or used yeast cellular material from the fermentation of a recombinant production host producing at least one carotenoid (and optionally at least one PUFA and/or at least one additional antioxidant) in commercially significant amounts, wherein the preferred production host is a recombinant strain of the oleaginous yeast, *Yarrowia lipolytica*. The biomass may be in the form of whole cells, whole cell lysates, homogenized cells, partially hydrolyzed cellular material, and/or partially purified cellular material (e.g., microbially produced oil).

The term "fermentable carbon source" means a carbon source that a microorganism will metabolize to derive energy. Typical carbon sources of the invention include, but are not limited to: monosaccharides, oligosaccharides, polysaccharides, alkanes, fatty acids, esters of fatty acids, monoglycerides, diglycerides, triglycerides, carbon dioxide, methanol, formaldehyde, formate and carbon-containing amines.

As used herein, an "isolated nucleic acid fragment" or "genetic construct" is a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

The term "complementary" is used to describe the relationship between nucleotide bases that are capable of hybridizing to one another. For example, with respect to DNA, adenosine is complementary to thymine and cytosine is complementary to guanine.

"Codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

"Chemically synthesized", as related to a sequence of DNA, means that the component nucleotides were assembled in vitro. Manual chemical synthesis of DNA may be accomplished using well-established procedures or, automated chemical synthesis can be performed using one of a number of commercially available machines. "Synthetic genes" can be assembled from oligonucleotide building blocks that are chemically synthesized using procedures known to those skilled in the art. These building blocks are ligated and annealed to form gene segments that are then enzymatically assembled to construct the entire gene. Accordingly, the genes can be tailored for optimal gene expression based on optimization of nucleotide sequence to reflect the codon bias of the host cell. The skilled artisan appreciates the likelihood of successful gene expression if codon usage is biased towards those codons favored by the host. Determination of preferred codons can be based on a survey of genes derived from the host cell, where sequence information is available. For example, the codon usage profile for *Yarrowia lipolytica* is provided in U.S. Pat. No. 7,125,672.

"Gene" refers to a nucleic acid fragment that expresses a specific protein, and that may refer to the coding region alone or may include regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene that is introduced into the host organism by gene transfer. Foreign genes can comprise native genes inserted into a non-native organism, native genes introduced into a new location within the native host, or chimeric genes. A "transgene" is a gene that has been introduced into the genome by a transformation procedure. A "codon-optimized gene" is a gene having its frequency of codon usage designed to mimic the frequency of preferred codon usage of the host cell.

"Coding sequence" refers to a DNA sequence that codes for a specific amino acid sequence. "Suitable regulatory sequences" refer to nucleotide sequences located upstream (5' non-coding sequences), within, or downstream (3' non-coding sequences) of a coding sequence (or located within an intron thereof), and which influence the transcription, RNA processing or stability, or translation of the associated coding sequence. Regulatory sequences may include promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters that cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The terms "3' non-coding sequences" and "transcription terminator" refer to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence.

"RNA transcript" refers to the product resulting from RNA polymerase-catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA. "Messenger RNA" or "mRNA" refers to the RNA that is without introns and that can be translated into protein by the cell. "cDNA" refers to a double-stranded DNA that is complementary to, and derived from, mRNA. "Sense" RNA refers to RNA transcript that includes the mRNA and so can be translated into protein by the cell. "Antisense RNA" refers to a RNA transcript that is complementary to all or part of a target primary transcript or mRNA and that blocks the expression of a target gene (U.S. Pat. No. 5,107,065; PCT Publication No. WO 99/28508). The complementarity of an antisense RNA may be with any part of the specific gene transcript, i.e., at the 5' non-coding sequence, 3' non-coding sequence, or the coding sequence. "Functional RNA" refers to antisense RNA, ribozyme RNA, or other RNA that is not translated and yet has an effect on cellular processes.

The term "operably linked" refers to the association of nucleic acid sequences on a single nucleic acid fragment so that the function of one is affected by the other. For example, a promoter is operably linked with a coding sequence when it is capable of affecting the expression of that coding sequence (i.e., the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragments of the invention. Expression may also refer to translation of mRNA into a polypeptide.

"Mature" protein refers to a post-translationally processed polypeptide, i.e., one from which any pre- or propeptides present in the primary translation product have been removed.

"Precursor" protein refers to the primary product of translation of mRNA, i.e., with pre- and propeptides still present. Pre- and propeptides may be (but are not limited to) intracellular localization signals.

The term "recombinase" refers to an enzyme(s) that carries out site-specific recombination to alter the DNA structure and includes transposases, lambda integration/excision enzymes, as well as site-specific recombinases.

"Recombinase site" or "site-specific recombinase sequence" means a DNA sequence that a recombinase will recognize and bind to. It will be appreciated that this may be a wild type or mutant recombinase site, as long as functionality is maintained and the recombinase enzyme may still recognize the site, bind to the DNA sequence, and catalyze recombination between two adjacent recombinase sites.

"Transformation" refers to the transfer of a nucleic acid molecule into a host organism, resulting in genetically stable inheritance. The nucleic acid molecule may be a plasmid that replicates autonomously, for example, or, it may integrate into the genome of the host organism. Host organisms containing the transformed nucleic acid fragments are referred to as "transgenic" or "recombinant" or "transformed" organisms.

The terms "plasmid" and "vector" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing an expression cassette(s) into a cell.

The term "expression cassette" refers to a fragment of DNA comprising the coding sequence of a selected gene and regulatory sequences preceding (5' non-coding sequences) and following (3' non-coding sequences) the coding sequence that are required for expression of the selected gene product. Thus, an expression cassette is typically composed of: (1) a promoter sequence; (2) a coding sequence (i.e., ORF); and, (3) a 3' untranslated region (i.e., a terminator) that, in eukaryotes, usually contains a polyadenylation site. The expression cassette(s) is usually included within a vector, to facilitate cloning and transformation. Different expression cassettes can be transformed into different organisms including bacteria, yeast, plants and mammalian cells, as long as the correct regulatory sequences are used for each host.

The term "homologous recombination" refers to the exchange of DNA fragments between two DNA molecules (during cross over). The fragments that are exchanged are flanked by sites of identical nucleotide sequences between the two DNA molecules (i.e., "regions of homology"). The term "regions of homology" refer to stretches of nucleotide sequence on nucleic acid fragments that participate in homologous recombination that have homology to each other. Effective homologous recombination will generally take place where these regions of homology are at least about 10 bp in length, where at least about 50 bp in length is preferred. Typically fragments that are intended for recombination contain at least two regions of homology where targeted gene disruption or replacement is desired.

As used herein, the term "chromosomal integration" means that a chromosomal integration vector becomes congruent with the chromosome of a microorganism through recombination between homologous DNA regions on the chromosomal integration vector and within the chromosome. Many of the modifications to the oleaginous yeast *Yarrowia lipolytica* were introduced by chromosomal integration.

As used herein, the term "chromosomal integration vector" means an extra-chromosomal vector that is capable of integrating into the host's genome through homologous recombination.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.*, 215:403-410 (1990)); 3.) DNASTAR (DNASTAR, Inc. Madison, Wis.); 4.) Sequencher (Gene Codes Corporation, Ann Arbor, Mich.); and, 5.) the FASTA program incorporating the Smith-Waterman algorithm (W. R. Pearson, *Comput. Methods Genome Res.*, [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein, "default values" will mean any set of values or parameters (as set by the software manufacturer) which originally load with the software when first initialized.

Standard recombinant DNA and molecular cloning techniques used herein are well known in the art and are described by Sambrook, J., Fritsch, E. F. and Maniatis, T., *Molecular Cloning: A Laboratory Manual*, 3$^{rd}$ ed., Cold Spring Harbor Laboratory: Cold Spring Harbor, N.Y. (2001) (hereinafter "Maniatis"); by Silhavy, T. J., Bennan, M. L. and Enquist, L. W., *Experiments with Gene Fusions*, Cold Spring Harbor Laboratory: Cold Spring Harbor, N.Y. (1984); and by Ausubel, F. M. et al., *Current Protocols in Molecular Biology*, published by Greene Publishing Assoc. and Wiley-Interscience, Hoboken, N.J. (1987).

Microbial Hosts for Carotenoid Production: Oleaginous Yeast

Oleaginous organisms are those organisms that tend to store their energy source in the form of lipid (Weete, In: Fungal Lipid Biochemistry, 2nd Ed., Plenum, 1980). Generally, the cellular oil content of these microorganisms follows a sigmoid curve, wherein the concentration of lipid increases until it reaches a maximum at the late logarithmic or early stationary growth phase and then gradually decreases during the late stationary and death phases (Yongmanitchai and Ward, Appl. *Environ. Microbiol.*, 57:419-25 (1991)).

The term "oleaginous yeast" refers to those microorganisms classified as yeasts that can accumulate in excess of about 25% of their dcw as oil, more preferably greater than about 30% of the dcw, and most preferably greater than about 40% of the dcw under oleaginous conditions. Examples of oleaginous yeast include, but are no means limited to, the following genera: *Yarrowia, Candida, Rhodotorula, Rhodosporidium, Cryptococcus, Trichosporon* and *Lipomyces*. More specifically, illustrative oil-synthesizing yeasts include: *Rhodosporidium toruloides, Liopmyces starkeyii, L. lipoferus, Candida revkaufi, C. pulcherrima, C. tropicalis, C. utilis, Trichosporon pullans, T. cutaneum, Rhodotorula glutinus, R. graminis* and *Yarrowia lipolytica* (formerly classified as *Candida lipolytica*). The technology for growing oleaginous yeast with high oil content is well developed (for example, see EP 0 005 277B1; Ratledge, C., *Prog. Ind. Microbiol.*, 16:119-206 (1982)); and, these organisms have been commercially used for a variety of purposes in the past.

Of those organisms classified as oleaginous yeast, *Yarrowia lipolytica* was selected as a preferred microbial host for the purposes herein. This selection was based on previous genetic engineering by the Applicants' Assignee resulting in significant production of various ω-3/ω-6 PUFAs (thereby demonstrating ease in genetic manipulation within the organism) and confirmation that the organism naturally produces high levels (at least about 2000 ppm) of the natural antioxidant CoQ$_9$. In preferred embodiments, the *Y. lipolytica* strains designated as ATCC #20362, ATCC #8862, ATCC #18944, ATCC #76982 and/or LGAM S(7)1 (Papanikolaou S., and Aggelis G., *Bioresour. Technol.*, 82 (1):43-9 (2002)) are preferred wildtype hosts, due to preliminary studies targeted toward identification of wildtype strains having high lipid content (measured as a percent DCW) and high volumetric productivity (measured as g/L h$^{-1}$).

Carotenoid Production in Oleaginous Yeast

The genetics of carotenoid biosynthesis are well known (Armstrong, G., in *Comprehensive Natural Products Chemistry*, Elsevier, v. 2, pp 321-352 (1999)); Lee, P. and Schmidt-Dannert, C., *Appl. Microbiol. Biotechnol.*, 60:1-11 (2002); Lee et al., *Chem. Biol.*, 10:453-462 (2003); Fraser, P. and Bramley, P., *Progress in Lipid Research*, 43:228-265 (2004)). This pathway is extremely well studied in the Gram-negative, pigmented bacteria of the genera *Pantoea*, formerly known as *Erwinia*. Of particular interest are the genes responsible for the production of C$_{40}$ carotenoids used as pigments in animal feeds (e.g., zeaxanthin, lutein, canthaxanthin and astaxanthin).

The enzymatic pathway involved in the biosynthesis of carotenoid compounds can be conveniently viewed in two parts: the upper isoprenoid pathway (isoprenoid biosynthesis is found in all organisms) providing farnesyl pyrophosphate (FPP); and, the lower carotenoid biosynthetic pathway (found in a subset of organisms), which converts FPP to C$_{40}$ carotenoids.

Farnesol Pyrophosphate Synthesis Via the Mevalonate Pathway:

The upper isoprenoid biosynthetic pathway leads to the production of the C$_5$ isoprene subunit, isopentenyl pyrophosphate (IPP). This biosynthetic process may occur through the mevalonate pathway (from acetyl CoA) or the non-mevalonate pathway (from pyruvate and glyceraldehyde-3-phosphate). The non-mevalonate pathway has been characterized in bacteria, green algae and higher plants, but not in yeast and animals (Horbach et al., *FEMS Microbiol. Lett.*, 111:135-140 (1993); Rohmer et al., *Biochem.*, 295:517-524 (1993); Schwender et al., *Biochem.*, 316:73-80 (1996); and, Eisenreich et al., *Proc. Natl. Acad. Sci. U.S.A.*, 93:6431-6436 (1996)).

Yeasts and animals typically use the mevalonate pathway to produce IPP, which is subsequently converted to FPP(C$_{15}$). In this pathway, 2 molecules of acetyl-CoA are condensed by thiolase to yield acetoacetyl-CoA, which is subsequently converted to 3-hydroxy-3-methylglutaryl-CoA (HMG-CoA) by the action of 3-hydroxymethyl-3-glutaryl-CoA synthase (HMG-CoA synthase). Next, 3-hydroxy-3-methylglutaryl-CoA reductase (HMG-CoA reductase; the rate controlling step in the mevalonate pathway) converts HMG-CoA to mevalonate, to which 2 molecules of phosphate residues are then added by the action of 2 kinases (i.e., mevalonate kinase and phosphomevalonate kinase, respectively). Mevalonate pyrophosphate is then decarboxylated by the action of mevalonate pyrophosphate decarboxylase to yield IPP, which becomes the building unit for a wide variety of isoprene molecules necessary in living organisms.

IPP is isomerized to dimethylaryl pyrophosphate (DMAPP) by the action of IPP isomerase. IPP and DMAPP are then converted to the $C_{10}$ unit geranyl pyrophosphate (GPP) by a head to tail condensation. In a similar condensation reaction between GPP and IPP, GPP is converted to the $C_{15}$ unit FPP, an important substrate in ergosterol biosynthesis in yeast. The biosynthesis of GPP and FPP from IPP and DMAPP is catalyzed by the enzyme FPP synthase.

Carotenoid Biosynthesis from Farnesyl Pyrophosphate:

Although the enzymatic pathway involved in the biosynthesis of carotenoid compounds converts FPP to a suite of carotenoids, the $C_{40}$ pathway can be subdivided into two parts comprising: (1) the $C_{40}$ backbone genes (i.e., crtE, crtB, crtI, and crtY) encoding enzymes responsible for converting FPP to β-carotene; and, (2) subsequent functionalization genes (e.g., crtW, crtO, crtR, crtX and crtZ, responsible for adding various functional groups to the β-ionone rings of β-carotene; and, Lut1, responsible for adding a hydroxyl group to α-carotene) (FIG. 1).

More specifically, the carotenoid biosynthetic pathway begins with the conversion of FPP to geranylgeranyl pyrophosphate (GGPP). In this first step, the enzyme geranylgeranyl pyrophosphate synthase (encoded by the crtE gene) condenses the $C_{15}$ FPP with IPP, creating the $C_{20}$ compound GGPP. Next, a phytoene synthase (encoded by the gene crtB) condenses two GGPP molecules to form phytoene, the first $C_{40}$ carotenoid compound in the pathway. Subsequently, a series of sequential desaturations (i.e., producing the intermediaries of phytofluene, ζ-carotene and neurosporene) occur, catalyzed by the enzyme phytoene desaturase (encoded by the gene crtI) and resulting in production of lycopene. Finally, the enzyme lycopene cyclase (encoded by the gene crtY) forms β-ionone rings on each end of lycopene, forming the bicyclic carotenoid β-carotene.

The rings of β-carotene can subsequently be functionalized by a carotenoid ketolase (encoded by the genes crtW, crtO or bkt) and/or carotenoid hydroxylase (encoded by the genes crtZ or crtR) forming commercially important xanthophyll pigments such as canthaxanthin, astaxanthin and zeaxanthin. In terms of the ketolation and hydroxylation reactions, the CrtW-type ketolases and the CrtZ-type hydroxylases are preferred in the present invention. The pathway from β-carotene to astaxanthin is somewhat non-linear in nature as a variety of intermediates can be formed (FIG. 1).

In alternate embodiments, the enzyme lycopene cyclase (encoded by the gene crtY) catalyzes formation of the bicyclic carotenoid α-carotene (α-carotene and β-carotene differ in the position of double bonds within their cyclic end groups). The rings of α-carotene can then be functionalized by a carotenoid hydroxylase (i.e., a crtZ or crtR gene) forming zeinoxanthin. This carotenoid is further modified by hydroxylation by an ε-hydroxylase (encoded by the gene lut1) to result in production of lutein.

Genetically Engineered Oleaginous Yeast for Carotenoid Production:

As is demonstrated in the present application, oleaginous yeast can be engineered to produce various $C_{40}$ carotenoids by integration of appropriate heterologous genes encoding crtE, crtY, crtI, crtB, crtZ, crtW and lut1 into the oleaginous host organism for production of any particular $C_{40}$ carotenoid of interest using FPP as the substrate, according to the general guidelines below in Table 2.

TABLE 2

Genes Required For Synthesis Of Various Carotenoids

| | crtE | crtB | crtI | crtY | crtW or crtO | crtZ or crtR | lut1 |
|---|---|---|---|---|---|---|---|
| Lycopene | 1 (+) | 1 (+) | 1 (+) | — | — | — | — |
| β-Carotene | 1 (+) | 1 (+) | 1 (+) | 1 (+) | — | — | — |
| Canthaxanthin | 1 (+) | 1 (+) | 1 (+) | 1 (+) | 1 (+) | — | — |
| Zeaxanthin | 1 (+) | 1 (+) | 1 (+) | 1 (+) | — | 1 (+) | — |
| Astaxanthin | 1 (+) | 1 (+) | 1 (+) | 1 (+) | 1 (+) | 1 (+) | — |
| Lutein | 1 (+) | 1 (+) | 1 (+) | 1 (+) | — | 1 (+) | 1 (+) |

Note:
The designation 1 (+) represents "one or more".

Thus, for example, production of a ketocarotenoid, such as canthaxanthin, will require expression of the $C_{40}$ backbone genes (i.e., crtE, crtB, crtI and crtY) and at least one carotenoid ketolase gene (i.e., crtW and/or crtO). Production of hydroxylated carotenoids, such as zeaxanthin and astaxanthin, require the expression of the $C_{40}$ backbone genes (i.e., crtE, crtB, crtI and crtY) and at least one carotenoid hydroxylating gene (i.e., crtZ).

It is contemplated that the particular functionalities required to be expressed in a specific oleaginous host organism for production of carotenoids will depend on the host cell (and its native isoprenoid and/or carotenoid pathway), the availability of substrate, and the desired end product(s). One skilled in the art will be able to identify various candidate genes encoding each of the enzymes desired for carotenoid biosynthesis. Useful crt gene sequences may be derived from any source, e.g., isolated from a natural source (from bacteria, algae, fungi, plants, animals, etc.), produced via a semi-synthetic route or synthesized de novo. Although the particular source of the crt genes introduced into the host is not critical, considerations for choosing a specific polypeptide having carotenogenic activity include: 1.) the substrate specificity and activity of the polypeptide; 2.) whether the polypeptide or a component thereof is a rate-limiting enzyme; 3.) whether the crt gene is essential for synthesis of a desired carotenoid; and/or, 4.) co-factors required by the polypeptide. The expressed polypeptide preferably has parameters compatible with the biochemical environment of its location in the host cell.

In additional embodiments, it will also be useful to consider the conversion efficiency of each particular Crt enzyme. More specifically, since each enzyme rarely functions with 100% efficiency to convert substrate to product, the final carotene profile of un-purified oils produced in a host cell will typically be a mixture of various carotenoids consisting of the desired carotenoid, as well as various upstream intermediary carotenoid. Thus, each enzyme's conversion efficiency is also a variable to consider, when optimizing biosynthesis of a particular carotenoid (e.g., astaxanthin).

With each of the considerations above in mind, candidate genes having the appropriate crtE, crtY, crtI, crtB, crtZ, crtR, crtO, crtW and lut1 activities can be identified according to publicly available literature (e.g., GenBank), the patent literature, and experimental analysis of organisms having the ability to produce carotenoids. These genes will be suitable for introduction into a specific host organism, to enable or enhance the organism's synthesis of carotenoids. Some non-limiting examples of suitable carotenoid biosynthesis genes include, but are not limited to the GenBank® Accession Number references provided below:

crtE: AB000835, AB016043, AB019036, AB016044, AB027705, AB027706, AB034249, AB034250, AF020041, AF049658, AF049659, AF139916, AF279807, AF279808, AJ010302, AJ133724, AJ276129, D85029, L25813, L37405, U15778, U44876, X92893, X95596, X98795 and Y15112;

crtB: AB001284, AB032797, AB034704, AB037975, AF009954, AF139916, AF152892, AF218415, AF220218, AJ010302, AJ133724, AJ278287, AJ304825 and AJ308385, D58420, L23424, L25812, L37405, M38424, M87280, S71770, U32636, U62808, U87626, U91900, X52291, X60441, X63873, X68017, X69172 and X78814;

crtI: AB046992, AF039585, AF049356, AF139916, AF218415, AF251014, AF364515, D58420, D83514, L16237, L37405, L39266, M64704, M88683, S71770, U37285, U46919, U62808, X55289, X59948, X62574, X68058, X71023, X78271, X78434, X78815, X86783, Y14807, Y15007, Y15112, Y15114 and Z11165;

crtY: AF139916, AF152246, AF218415, AF272737, AJ133724, AJ250827, AJ276965, D58420, D83513, L40176, M87280, U50738, U50739, U62808, X74599, X81787, X86221, X86452, X95596 and X98796;

crtZ: D58420, D58422, D90087, M87280, U62808 and Y15112;

crtX: D90087, M87280 and M90698;

crtW: AF218415, D45881, D58420, D58422, X86782 and Y15112; and, lut1: AAR83120, EDO99174 and NP_564384.

Preferred sources of carotenoid biosynthesis genes are from *Pantoea stewartii* (ATCC #8199; PCT Publication No. WO 2002/079395), *Pantoea stewartii* DC413 (U.S. Pat. No. 7,288,387), *Pantoea agglomerans* DC404 (U.S. Pat. No. 6,929,928), Enterobacteriaceae DC260 (U.S. Pat. No. 7,064,196), *Brevundimonas vesicularis* DC263 (U.S. Pat. No. 7,252,985 and U.S. Pat. No. 7,091,031), *Sphingomonas melonis* DC18 (U.S. Pat. No. 7,252,985), *Novosphingobium aromaticivorans* ATCC #700278 (U.S. Pat. No. 7,091,031) and *Agrobacterium aurantiacum* (U.S. Pat. No. 5,811,273, U.S. Pat. No. 5,972,690 and U.S. Pat. No. 6,150,130).

Depending upon the source of carotenoid biosynthesis gene(s), it may be necessary to codon-optimize at least a portion (up to the entire length) of the gene targeted for heterologous expression using the preferred codon usage within the host cell. The preferred codon usage for *Yarrowia lipolytica* has previously been reported (see U.S. Pat. No. 7,125,672).

Thus, in one embodiment the present invention provides a recombinant oleaginous yeast production host for the production of astaxanthin comprising:

a.) at least one copy of a crtE gene encoding a GGPP synthase;
b.) at least one copy of a crtB gene encoding a phytoene synthase;
c.) at least one copy of a crtI gene encoding a phytoene desaturase;
d.) at least one copy of a crtY gene encoding a lycopene cyclase;
e.) at least one copy of a crtZ gene encoding a carotenoid hydroxylase; and,
f.) at least one copy of a crtW gene encoding a carotenoid ketolase;

wherein said oleaginous yeast produces at least about 25 wt % of its dcw as oil.

Alternate embodiments of the present invention are drawn to a recombinant oleaginous yeast production host for the production of lycopene, comprising at least one copy each of crtE, crtB and crtI genes.

Similarly, alternate embodiments of the present invention are drawn to a recombinant oleaginous yeast production host for the production of β-carotene, comprising at least one copy each of crtE, crtB, crtI and crtY genes.

In additional embodiments of the present invention, a recombinant oleaginous yeast production host for the production of zeaxanthin is claimed, wherein the host comprises at least one copy each of crtE, crtB, crtI, crtY and crtZ genes.

Alternate embodiments of the present invention are drawn to a recombinant oleaginous yeast production host for the production of lutein, comprising at least one copy each of crtE, crtB, crtI crtY, crtZ and lut1 genes.

Furthermore, the present invention provides a recombinant oleaginous yeast production host for the production of canthaxanthin, wherein the host comprises at least one copy each of crtE, crtB, crtI, crtY and crtW genes.

In preferred embodiments, the recombinant oleaginous yeast production host in any of the above embodiments is a recombinant strain of *Yarrowia lipolytica*. In a further aspect, the recombinant oleaginous yeast production host produces at least about 30-40 wt %, and most preferably at least about 40-50 wt % microbially-produced oil, in addition to carotenoids.

Relatedly, the invention provides a method to produce a pigmented oleaginous yeast biomass comprising a carotenoid compound, comprising:

a.) providing any of the recombinant production hosts of the present invention expressing at least one copy each of crtE, crtB and crtI genes (and optionally expressing at least one copy each of crtY, crtZ, crtW and/or lut1 genes, according to the requirements of Table 2), wherein said production host accumulates at least 25 wt % of its dcw as oil; and,
b.) culturing the recombinant production host under suitable conditions whereby pigmented oleaginous yeast biomass comprising a carotenoid compound is produced (wherein the preferred carotenoid compound is selected from the group consisting of: astaxanthin, β-carotene, lycopene, lutein, zeaxanthin and canthaxanthin).

Of course, a variety of means are available to increase the total amount of carotenoid that is produced in the above recombinant oleaginous yeast. For example, previous work in *Yarrowia lipolytica* has demonstrated that use of strong promoters, expression in multicopy, and/or codon-optimization of heterologous genes can very successfully be used as a means to increase expression. These tools should be equally applicable with respect to expression of carotenoid biosynthetic genes (e.g., encoded by crtE, crtB, crtI, crtY, crtW, crtZ and/or lut1 genes). Thus, in preferred embodiments, the recombinant oleaginous yeast comprises a plurality of each codon-optimized crt gene required to product the desired carotenoid. For clarity, for example, if 2 copies of a crtY are required, this can refer to: (1) two copies of an identical coding sequence for a particular crtY isolated from a single species; or, (2) one coding sequence for crtY isolated from a species "A" and one coding sequence for a crtY isolated from a species "B", thus collectively resulting in two crtY genes. This strategy is exemplified in Example 10 in the β-carotene-producing *Yarrowia lipolytica* strain series YCS8700. Specifically, a single copy each of synthetic crtE, crtB and crtI genes (each codon-optimized for expression in *Y. lipolytica*) was expressed, in addition to 3 copies of different synthetic crtY genes (i.e., crtY392$_{syn}$, derived from *Pantoea stewartii* DC413; crtY343$_{syn}$, derived from Enterobacteriaceae DC260; and, crtY334$_{syn}$, derived from *Pantoea agglomerans* DC404), wherein each crtY was codon-optimized for expression in *Y. lipolytica*.

Manipulation of pathways and global regulators that affect production of carotenoids and/or down-regulate expression of specific genes within the carotenoid biosynthetic pathway that diminish overall accumulation of carotenoids are also contemplated as a means to increase carotenoid production. For example, it may be useful to increase the production of FPP to thereby enable increased production of carotenoids. Introducing and/or amplifying the idi gene (responsible for isomerization of IPP to dimethyl allyl diphosphate, a rate limiting step in the biosynthesis of carotenoids genes [Wang et al., *Biotechnol. Bioeng.*, 62:235-241 (1999)]) may accomplish this.

In certain embodiments of the invention, it will be desirable to accumulate carotenoids in the recombinant oleaginous host to levels (i.e., considering the total amount of all produced carotenoids together) that are greater than at least about 100 ppm, preferably at least about 500 ppm, more preferably at least about 1000 ppm, and even more preferably at least about 10,000 ppm. It should be noted that, for those recombinant oleaginous yeast hosts that produce more than one carotenoid, it will sometimes be possible to adjust the relative amounts of individual carotenoids produced by adjusting growth conditions. For example, it has been reported that controlling the concentration of dissolved oxygen in a culture during cultivation can regulate relative production levels of certain carotenoids such as β-carotene, echinenone, β-cryptoxanthin, 3-hydroxyechinenone, asteroidenone, canthaxanthin, zeaxanthin, adonirubin, adonixanthin and astaxanthin (see, for example, U.S. Pat. No. 6,825,002).

Production of Carotenoids and PUFAs in Oleaginous Yeast

In certain embodiments, the oleaginous yeast co-produces carotenoids and PUFAs. The importance of PUFAs is well understood. For example, certain PUFAs are important biological components of healthy cells and are recognized as: "essential" fatty acids that cannot be synthesized de novo in mammals and instead must be obtained either in the diet or derived by further desaturation and elongation of linoleic acid (LA; 18:2 ω-6) or α-linolenic acid (ALA; 18:3 ω-3); constituents of plasma membranes of cells, where they may be found in such forms as phospholipids or TAGs; necessary for proper development (particularly in the developing infant brain) and for tissue formation and repair; and, precursors to several biologically active eicosanoids of importance in mammals (e.g., prostacyclins, eicosanoids, leukotrienes, prostaglandins). Additionally, a high intake of long-chain ω-3 PUFAs has cardiovascular protective effects (Dyerberg, J. et al., *Amer. J. Clin. Nutr.*, 28:958-966 (1975); Dyerberg, J. et al., *Lancet*, 2 (8081):117-119 (1978); Shimokawa, H., *World Rev. Nutr. Diet*, 88:100-108 (2001); von Schacky, C. and Dyerberg, J., *World Rev. Nutr. Diet*, 88:90-99 (2001)). Numerous other studies document wide-ranging health benefits conferred by administration of ω-3/ω-6 PUFAs against a variety of symptoms and diseases (e.g., asthma, psoriasis, eczema, diabetes, cancer).

Polyunsaturated Fatty Acid Definitions and Biosynthetic Pathway:

Nomenclature used to describe PUFAs is shown below in Table 3. In the column titled "Shorthand Notation", the omega-reference system is used to indicate the number of carbons, the number of double bonds and the position of the double bond closest to the omega carbon, counting from the omega carbon (which is numbered 1 for this purpose). The remainder of the Table summarizes the common names of ω-3 and ω-6 fatty acids and their precursors, the abbreviations that will be used throughout the specification and each compounds' chemical name.

TABLE 3

Nomenclature of Various PUFAs And Precursors

| Common Name | Abbreviation | Chemical Name | Shorthand Notation |
|---|---|---|---|
| Myristic | — | tetradecanoic | 14:0 |
| Palmitic | Palmitate | hexadecanoic | 16:0 |
| Palmitoleic | — | 9-hexadecenoic | 16:1 |
| Stearic | — | octadecanoic | 18:0 |
| Oleic | — | cis-9-octadecenoic | 18:1 |
| Linoleic | LA | cis-9,12-octadecadienoic | 18:2 ω-6 |
| γ-Linolenic | GLA | cis-6,9,12-octadecatrienoic | 18:3 ω-6 |
| Eicosadienoic | EDA | cis-11,14-eicosadienoic | 20:2 ω-6 |
| Dihomo-γ-Linolenic | DGLA | cis-8,11,14-eicosatrienoic | 20:3-ω6 |
| Arachidonic | ARA | cis-5,8,11,14-eicosatetraenoic | 20:4 ω-6 |
| α-Linolenic | ALA | cis-9,12,15-octadecatrienoic | 18:3 ω-3 |
| Stearidonic | STA | cis-6,9,12,15-octadecatetraenoic | 18:4 ω-3 |
| Eicosatrienoic | ETrA | cis-11,14,17-eicosatrienoic | 20:3 ω-3 |
| Eicosa-tetraenoic | ETA | cis-8,11,14,17-eicosatetraenoic | 20:4 ω-3 |
| Eicosa-pentaenoic | EPA | cis-5,8,11,14,17-eicosapentaenoic | 20:5 ω-3 |
| Docosa-pentaenoic | DPA | cis-7,10,13,16,19-docosapentaenoic | 22:5 ω-3 |
| Docosa-hexaenoic | DHA | cis-4,7,10,13,16,19-docosahexaenoic | 22:6 ω-3 |

"Percent (%) PUFAs in the total lipid" refers to the percent of PUFAs relative to the total fatty acids in those fractions. As used herein, the term "total lipid fraction" or "lipid fraction" both refer to the sum of all lipids (i.e., neutral and polar) within an oleaginous organism, thus including those lipids that are located in the phosphatidylcholine fraction, phosphatidyletanolamine fraction and TAG (or oil) fraction. However, as used herein, the terms "lipid" and "oil" will be used interchangeably throughout the specification.

The term "PUFA biosynthetic pathway" refers to a metabolic process that converts oleic acid to LA, EDA, GLA, DGLA, ARA, ALA, STA, ETrA, ETA, EPA, DPA and DHA. This process is well described in the literature (e.g., see PCT Publication No. WO 2006/052870). Simplistically, this process involves elongation of the carbon chain through the addition of carbon atoms and desaturation of the molecule through the addition of double bonds, via a series of special elongation and desaturation enzymes, respectively, (i.e., "PUFA biosynthetic pathway enzymes") present in the endoplasmic reticulim membrane. More specifically, "PUFA biosynthetic pathway enzyme" refers to any of the following enzymes (and genes which encode said enzymes) associated with the biosynthesis of a PUFA, including: a Δ9 elongase, a $C_{14/16}$ elongase, a $C_{16/18}$ elongase, a $C_{18/20}$ elongase, a $C_{20/22}$ elongase. a Δ4 desaturase, a Δ5 desaturase, a Δ6 desaturase, a Δ8 desaturase, Δ9 desaturase, a Δ12 desaturase, a Δ15 desaturase, and/or Δ17 desaturase.

The term "ω-3/ω-6 fatty acid biosynthetic pathway" refers to a set of genes which, when expressed under the appropriate conditions encode enzymes that catalyze the production of either or both ω-3 and ω-6 fatty acids. Typically the genes involved in the ω-3/ω-6 fatty acid biosynthetic pathway encode PUFA biosynthetic pathway enzymes.

Figure 2:
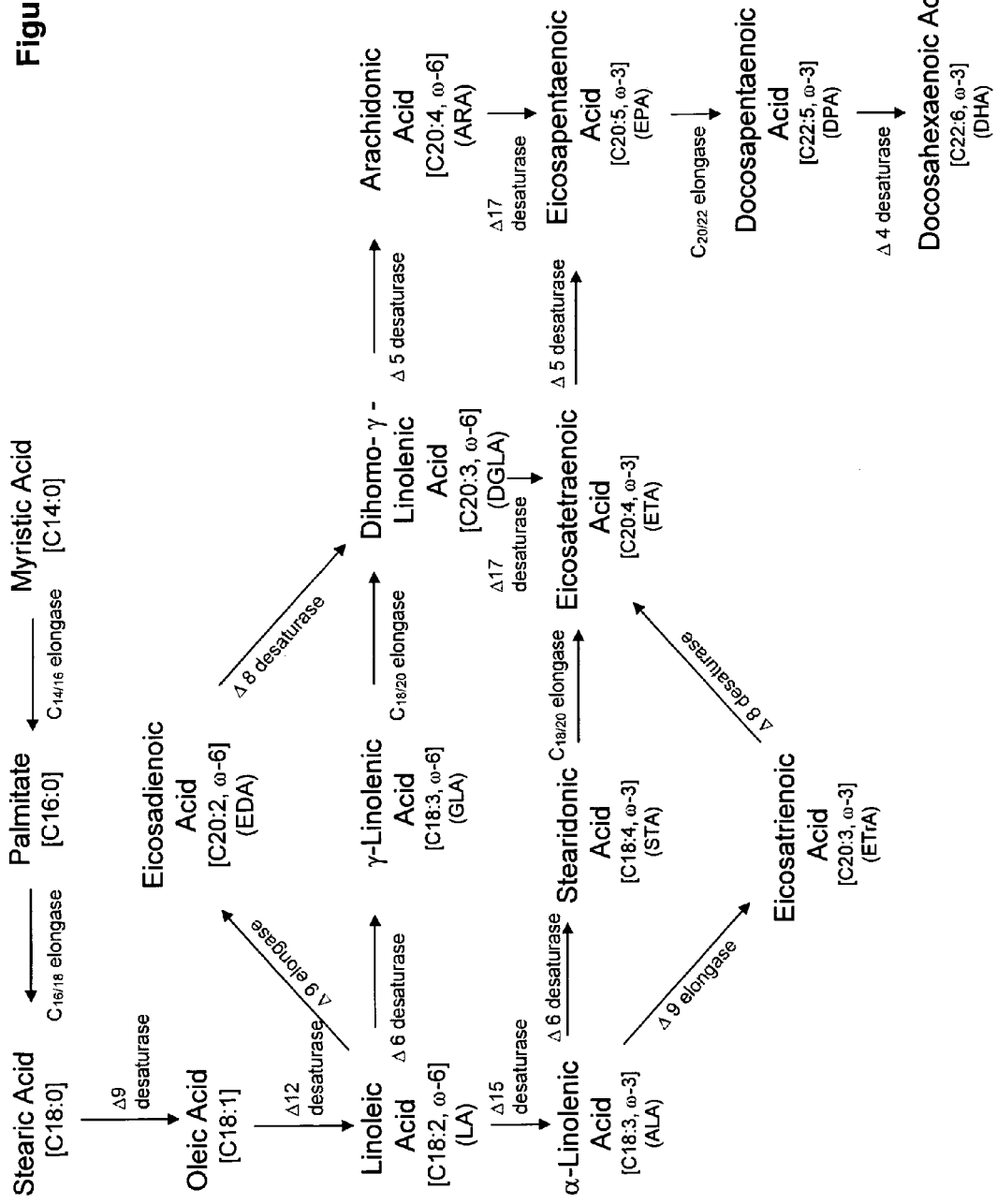
FIG. 2 illustrates the ω-3/ω-6 fatty acid biosynthetic pathway.

More specifically, a representative pathway is illustrated in FIG. 2, providing for the conversion of myristic acid through various intermediates to DHA, which demonstrates how both ω-3 and ω-6 fatty acids may be produced from a common source. The pathway is naturally divided into two portions wherein one portion will generate ω-3 fatty acids and the other portion, only ω-6 fatty acids. However, as seen in FIG. 2 and as described below, there are often multiple alternate pathways for production of a specific PUFA.

All pathways require the initial conversion of oleic acid to LA, the first of the ω-6 fatty acids, by a Δ12 desaturase. Then, using the "Δ9 elongase/Δ8 desaturase pathway" and LA as substrate, long-chain ω-6 and ω-3 fatty acids are formed as follows: (1) LA is converted to EDA by a Δ9 elongase; (2) EDA is converted to DGLA by a Δ8 desaturase; (3) DGLA is converted to ARA by a Δ5 desaturase; and, (4) ARA is converted to EPA by Δ17 desaturase. Alternatively, the "Δ9 elongase/Δ8 desaturase pathway" can use ALA as substrate to produce long-chain ω-3 fatty acids as follows: (1) LA is converted to ALA, the first of the ω-3 fatty acids, by a Δ15 desaturase; (2) ALA is converted to ETrA by a Δ9 elongase; (3) ETrA is converted to ETA by a Δ8 desaturase; (4) ETA is converted to EPA by a Δ5 desaturase; (5) EPA is converted to DPA by a $C_{20/22}$ elongase; and, (6) DPA is converted to DHA by a Δ4 desaturase. Optionally, ω-6 fatty acids may be converted to ω-3 fatty acids; for example, ETA and EPA are produced from DGLA and ARA, respectively, by Δ17 desaturase activity.

Alternate pathways for the biosynthesis of ω-3/ω-6 fatty acids utilize a Δ6 desaturase and $C_{18/20}$ elongase (i.e., the "Δ6 desaturase/Δ6 elongase pathway"). More specifically, LA and ALA may be converted to GLA and STA, respectively, by a Δ6 desaturase; then, a $C_{18/20}$ elongase converts GLA to DGLA and/or STA to ETA. Downstream PUFAs are subsequently formed as described above.

As used herein, the term "functional" in context with the ω-3/ω-6 fatty acid biosynthetic pathway means that some (or all of) the genes in the pathway express active enzymes, resulting in in vivo catalysis or substrate conversion. It should be understood that "ω-3/ω-6 fatty acid biosynthetic pathway" or "functional ω-3/ω-6 fatty acid biosynthetic pathway" does not imply that all the genes listed in the above paragraphs are required, as a number of fatty acid products will only require the expression of a subset of the genes of this pathway.

As used herein, the term "desaturase" refers to a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. Of particular interest herein are: 1) Δ5 desaturases that catalyze the conversion of DGLA to ARA and/or ETA to EPA; 2.) Δ17 desaturases that desaturate a fatty acid between the 17$^{th}$ and 18$^{th}$ carbon atom numbered from the carboxyl-terminal end of the molecule and which, for example, catalyze the conversion of ARA to EPA and/or DGLA to ETA; 3.) Δ6 desaturases that catalyze the conversion of LA to GLA and/or ALA to STA; 4.) Δ12 desaturases that catalyze the conversion of oleic acid to LA; 5.) Δ15 desaturases that catalyze the conversion of LA to ALA and/or GLA to STA; 6.) Δ4 desaturases that catalyze the conversion of DPA to DHA; 7.) Δ8 desaturases that catalyze the conversion of EDA to DGLA and/or ETrA to ETA; and, 8.) Δ9 desaturases that catalyze the conversion of palmitate to palmitoleic acid (16:1) and/or stearate to oleic acid. In the art, Δ15 and Δ17 desaturases are also occasionally referred to as "omega-3 desaturases", "ω-3 desaturases", and/or "Δ-3 desaturases", based on their ability to convert ω-6 fatty acids into their ω-3 counterparts (e.g., conversion of LA into ALA and ARA into EPA, respectively). In some embodiments, it is most desirable to empirically determine the specificity of a particular fatty acid desaturase by transforming a suitable host with the gene for the fatty acid desaturase and determining its effect on the fatty acid profile of the host.

As used herein, the term "elongase" refers to a polypeptide that can elongate a fatty acid carbon chain to produce an acid that is 2 carbons longer than the fatty acid substrate that the elongase acts upon. This process of elongation occurs in a multi-step mechanism in association with fatty acid synthase, as described in PCT Publication No. WO 2005/047480. Examples of reactions catalyzed by elongase systems are the conversion of GLA to DGLA, STA to ETA and EPA to DPA. In general, the substrate selectivity of elongases is somewhat broad but segregated by both chain length and the degree and type of unsaturation. For example, a $C_{14/16}$ elongase will utilize a $C_{14}$ substrate (e.g., myristic acid), a $C_{16/18}$ elongase will utilize a $C_{16}$ substrate (e.g., palmitate), a $C_{18/20}$ elongase will utilize a $C_{18}$ substrate (e.g., GLA, STA) and a $C_{20/22}$ elongase will utilize a $C_{20}$ substrate (e.g., EPA). In like manner, a Δ9 elongase is able to catalyze the conversion of LA and ALA to EDA and ETrA, respectively. It is important to note that some elongases have broad specificity and thus a single enzyme may be capable of catalyzing several elongase reactions (e.g., thereby acting as both a $C_{16/18}$ elongase and a $C_{18/20}$ elongase).

Genetically Engineered Oleaginous Yeast for PUFA Production:

As described above, oleaginous yeast can be engineered to produce ω-3/ω-6 PUFAs by integration of appropriate heterologous genes encoding desaturases and elongases of the Δ6 desaturase/Δ6 elongase pathway or the Δ9 elongase/Δ8 desaturase pathway into the host organism for production of any particular PUFA of interest. Preferred genes and considerations for choosing a specific polypeptide having desaturase or elongase activity are detailed in U.S. patent application Ser. No. 11/198,975, and Publication No. US-2006-0110806, as are details concerning additional modifications that may be required to enable high level production of a particular PUFA, including: (1) manipulation of the activity of acyltransferases that allow for the transfer of omega fatty acids into storage lipid pools (i.e., the TAG fraction); (2) over-expression of desaturases, elongases and diacylglycerol cholinephosphotransferases by use of strong promoters, expression in multicopy, and/or codon-optimization; (3) down-regulation of the expression of specific genes that diminish overall accumulation of the desired PUFA; (4) manipulation of pathways and global regulators that affect production of the desired PUFA; and, (5) "pushing/pulling" within the PUFA biosynthetic pathway. The term "high-level production" refers to production of at least about 5-10% of the desired PUFA (i.e., LA, ALA, EDA, GLA, STA, ETrA, DGLA, ETA, ARA, EPA, DPA and/or DHA) in the total lipids of the microbial host, preferably at least about 10-25% of the desired PUFA in the total lipids, more preferably at least about 25-35% of the desired PUFA in the total lipids, more preferably at least about 35-45% of the desired PUFA in the total lipids, and most preferably at least about 45-55% of the desired PUFA in the total lipids. The structural form of the PUFA is not limiting; thus, for example, the EPA may exist in the total lipids as free fatty acids or in esterified forms such as acylglycerols, phospholipids, sulfolipids or glycolipids.

Although numerous oleaginous yeast could be engineered for production of preferred ω-3/ω-6 PUFAs based on the teachings in the present invention and in co-pending U.S. patent application Ser. No. 11/198,975, Ser. No. 11/265,761, Ser. No. 11/264,784, and Ser. No. 11/264,737, representative strains of the oleaginous yeast Yarrowia lipolytica are described in Table 4. These include the following strains that have been deposited with the ATCC: *Y. lipolytica* strain Y2047 (producing ARA; ATCC Accession No. PTA-7186); *Y. lipolytica* strain Y2096 (producing EPA; ATCC Accession No. PTA-7184); *Y. lipolytica* strain Y2201 (producing EPA; ATCC Accession No. PTA-7185); and, *Y. lipolytica* strain Y3000 (producing DHA ATCC Accession No. PTA-7187). Additionally, *Y. lipolytica* strain Y4128; ATCC Accession No. PTA-8614) is described in U.S. Patent Application No. 60/977,177 (filed Oct. 3, 2007). Example 7 herein describes *Y. lipolytica* strain Y4127 (producing EPA; ATCC Accession No. PTA-[XXXX]).

the carotenoid is not used as a pigment but is used as a natural antioxidant (e.g., use of lycopene as an antioxidant in food products and/or animal feeds). Thus, it is expected that the presence of the carotenoids should minimize overall lipid peroxidation and thus stabilize the PUFAs during production and/or storage.

In alternate embodiments wherein the utility of the carotenoid is as a pigment versus as an antioxidant, it may be advantageous to produce a single product that comprises both carotenoids and PUFAs to simplify subsequent formulations

TABLE 4

Lipid Profile Of Representative *Yarrowia lipolytica* Strains Engineered To Produce ω-3/ω-6 PUFAs

| Strain | Reference | ATCC Deposit No. | 16:00 | 16:01 | 18:00 | 18:01 | 18:02 | GLA | 20:02 | DGLA | ARA | ETA | EPA | DPA | DHA | Lipid % dcw |
|---|---|---|---|---|---|---|---|---|---|---|---|---|---|---|---|---|
| Wildtype | US 2006- | #76982 | 14 | 11 | 3.5 | 34.8 | 31 | 0 | — | — | — | — | — | — | — | — |
| pDMW208 | 0035351-A1; | — | 11.9 | 8.6 | 1.5 | 24.4 | 17.8 | 25.9 | — | — | — | — | — | — | — | — |
| pDMW208D62 | WO2006/033723 | — | 16.2 | 1.5 | 0.1 | 17.8 | 22.2 | 34 | — | — | — | — | — | — | — | — |
| M4 | US 2006-0115881-A1; WO2006/052870 | — | 15 | 4 | 2 | 5 | 27 | 35 | — | 8 | 0 | 0 | 0 | — | — | — |
| Y2034 | US 2006- | — | 13.1 | 8.1 | 1.7 | 7.4 | 14.8 | 25.2 | — | 8.3 | 11.2 | — | — | — | — | — |
| Y2047 | 0094092-A1; | PTA-7186 | 15.9 | 6.6 | 0.7 | 8.9 | 16.6 | 29.7 | — | 0 | 10.9 | — | — | — | — | — |
| Y2214 | WO2006/055322 | — | 7.9 | 15.3 | 0 | 13.7 | 37.5 | 0 | — | 7.9 | 14 | — | — | — | — | — |
| EU | US 2006- | — | 19 | 10.3 | 2.3 | 15.8 | 12 | 18.7 | — | 5.7 | 0.2 | 3 | 10.3 | — | — | 36 |
| Y2072 | 0115881-A1; | — | 7.6 | 4.1 | 2.2 | 16.8 | 13.9 | 27.8 | — | 3.7 | 1.7 | 2.2 | 15 | — | — | — |
| Y2102 | WO2006/052870 | — | 9 | 3 | 3.5 | 5.6 | 18.6 | 29.6 | — | 3.8 | 2.8 | 2.3 | 18.4 | — | — | — |
| Y2088 | | — | 17 | 4.5 | 3 | 2.5 | 10 | 20 | — | 3 | 2.8 | 1.7 | 20 | — | — | — |
| Y2089 | | — | 7.9 | 3.4 | 2.5 | 9.9 | 14.3 | 37.5 | — | 2.5 | 1.8 | 1.6 | 17.6 | — | — | — |
| Y2095 | | — | 13 | 0 | 2.6 | 5.1 | 16 | 29.1 | — | 3.1 | 1.9 | 2.7 | 19.3 | — | — | — |
| Y2090 | | — | 6 | 1 | 6.1 | 7.7 | 12.6 | 26.4 | — | 6.7 | 2.4 | 3.6 | 26.6 | — | — | 22.9 |
| Y2096 | | PTA-7184 | 8.1 | 1 | 6.3 | 8.5 | 11.5 | 25 | — | 5.8 | 2.1 | 2.5 | 28.1 | — | — | 20.8 |
| Y2201 | | PTA-7185 | 11 | 16.1 | 0.7 | 18.4 | 27 | — | 3.3 | 3.3 | 1 | 3.8 | 9 | — | — | — |
| Y3000 | US 2006-0110806-A1; WO2006/052871 | PTA-7187 | 5.9 | 1.2 | 5.5 | 7.7 | 11.7 | 30.1 | — | 2.6 | 1.2 | 1.2 | 4.7 | 18.3 | 5.6 | — |

Genetically Engineered Oleaginous Yeast for Carotenoid Production and PUFA Production:

Lipid peroxidation, which leads to rancidity in oils, most often affects PUFAs, because they contain multiple double bonds in between which lie methylene (i.e., —$CH_2$) groups that are especially reactive to hydrogen. The oxygen-dependent deterioration can occur non-enzymatically via a free radical chain reaction mechanism (i.e., autoxidation) or via photo-oxygenation; additionally, fatty acids may also be peroxidized via enzymatic peroxidation (i.e., via lipoxygenase enzymes). Furthermore, fatty acids may be autoxidized either in free form or combined into glycerolipids or glycolipids. Thus, oxidized triacylglycerol monomers include molecules containing different oxygenated groups, mainly hydroxyl-, keto- and epoxy-, as well as short-chain fatty acyl and short-chain n-oxo fatty acyl groups as the main products (Chang, S. S. et al., *JOACS*, 55:718 (1978); Velasco, J. et al., *Eur. J. Lipid Sci. Technol.*, 106:728 (2004)). Autoxidation of fatty acids with more than 3 double bonds leads to even more complex mixtures of product (e.g., see Porter, N. A. et al., *J. Am. Chem. Soc.*, 103:6447 (1981) and Bruna, E. et al., *Lipids*, 24:970 (1990) concerning autoxidation of arachidonic, pentaenoic and hexaenoic acids).

Based on the above, a recombinant oleaginous yeast engineered to co-produce both carotenoids and PUFAs should prove advantageous. Carotenoids are themselves generally classified as antioxidants; and, in certain product applications and manufacture (e.g., aquaculture feeds often require at least carotenoid pigment [i.e., canthaxanthin and/or astaxanthin] and ω-3 PUFAs).

One embodiment of the present invention encompasses a recombinant oleaginous yeast production host for the production of carotenoids and PUFAs comprising:

a) a functional carotenoid biosynthetic pathway, wherein expression of said carotenoid biosynthetic pathway results in the production of at least one carotenoid selected from the group consisting of: lycopene, β-carotene, canthaxanthin, zeaxanthin, lutein and astaxanthin; and, b) a functional ω-3/ω-6 PUFA biosynthetic pathway, wherein expression of said ω-3/ω-6 PUFA biosynthetic pathway results in the production of at least one PUFA selected from the group consisting of: an ω-6 PUFA and an ω-3 PUFA;

wherein said oleaginous yeast produces at least about 25 wt % of its dcw as oil.

Similarly, the invention comprises a method to produce a pigmented oleaginous yeast biomass comprising a carotenoid compound and a PUFA, comprising: a.) providing the recombinant production host described above, wherein said production host accumulates at least 25 wt % of its dcw as oil and wherein said product host comprises a functional carotenoid biosynthetic pathway and a functional ω-3/ω-6 PUFA biosynthetic pathway; and, b.) culturing the recombinant production host under suitable conditions whereby pigmented oleaginous yeast biomass is produced comprising a carotenoid and an ω-3 and/or an ω-6 PUFA (preferably selected from the group consisting of LA, ALA, EDA, GLA, STA, ETrA, DGLA, ETA, ARA, EPA, DPA and DHA).

In preferred embodiments, the oleaginous yeast is a recombinant strain of *Yarrowia lipolytica* that has been previously engineered for high-level production of a preferred ω-3/ω-6 PUFA. Upon transformation with a functional carotenoid biosynthetic pathway using the methodology described previously, the resultant recombinant yeast will co-produce carotenoids and PUFAs.

Production of Carotenoids and Additional Antioxidants in Oleaginous Yeast

In some embodiments, the oleaginous yeast co-produces carotenoids and at least one additional antioxidant (i.e., wherein the additional antioxidant is not a carotenoid). Antioxidants slow the rate of oxidation reactions or that can counteract the damaging effects of oxygen. A variety of nutrients or dietary components have antioxidant properties and thus can function to decrease the tissue content of reactive oxygen. Common antioxidants include vitamins C and E, β-carotene, proanthocyanidin, the minerals selenium and zinc, and coenzyme Q. Similarly, resveratrol is a potent antioxidant reported to have numerous beneficial effects.

The antioxidant properties of CoQ are significant. In addition to quenching free radicals that threaten cellular components (e.g., nucleic acids, proteins) in the mitochondria, ubiquinol also inhibits lipid peroxidation (i.e., degradation of lipids) in biological membranes and in low-density lipoprotein (LDL). As such, the coenzyme has become widely used as a nutritional supplement and as a pharmacological active agent. It has wide use and acceptance in the treatment of: mitochondrial disorders, cardiovascular disease processes, atherosclerosis, slow muscle degeneration (dystrophy or atrophy), neurodegenerative diseases (e.g., Parkinson's disease, Huntington's disease, Alzheimer's, amyotrophic lateral sclerosis (ALS)), periodontal disease, diabetes and CoQ deficiencies. $CoQ_{10}$ is also believed to strengthen the immune system, act as an anticancer agent and help counteract the aging processes.

The antioxidant properties of resveratrol decrease LDL oxidation, a factor associated with the development of atherosclerosis (Manna et al., *J. Immunol.*, 164:6509-6519 (2000)). It is also reported to lower serum cholesterol levels and the incidents of heart disease. This effect as been attributed to a phenomenon known and the "French Paradox". French citizens that regularly consume red wine tend to have lower incidents of heart disease and serum cholesterol levels even though this same group tends to consume foods high in both fat and cholesterol. There is also evidence that resveratrol may have other cardiovascular protective effects including modulation of vascular cell function, suppression of platelet aggregation, and reduction of myocardial damage during ischemia-reperfusion (Bradamante et al., *Cardiovasc. Drug. Rev.*, 22 (3):169-188 (2004)). Resveratrol is reported to have anti-inflammatory effects associated with the inhibition of the cyclooxygenase-1 (Cox-1), an enzyme associated with the conversion of ARA to pro-inflammatory mediators. It may also aid in the inhibition of carcinogenesis (Schultz, J., *J Natl Cancer Inst.*, 96 (20):1497-1498 (2004); Scifo et al., *Oncol Res.*, 14 (9):415-426 (2004); and Kundu, J. and Surh, Y., *Mutat Res.*, 555 (1-2):65-80 (2004)).

Resveratrol is classified as a phytoalexin due to its antifungal properties. It appears that some plants (e.g., red grapes) produce resveratrol as natural defense mechanism against fungal infections. Transgenic plants modified to express the resveratrol synthase gene exhibit improved resistance to fungal infections. Furthermore, it has been reported that treatment of fresh fruits and vegetables with an effective amount of resveratrol will significantly increase shelf life (Gonzalez-Urena et al., *J. Agric. Food Chem.*, 51:82-89 (2003)).

Although $CoQ_{10}$ is currently available via chemical synthesis, semi-chemical synthesis and microbial conversion (Choi, Jin-Ho et al., *Appl. Microbiol. Biotechnol.*, 68:9-15 (2005)), use of resveratrol in commercial products is limited due to the current market price of the compound. Engineering an oleaginous microorganism to simultaneously produce both carotenoids and at least one additional antioxidant (e.g., CoQ, resveratrol, or mixtures thereof) could create a higher value product or reduce production costs, if a synthetic antioxidant was no longer required, safety concerns with the synthetic antioxidant were avoided, or difficult co-formulations from individual ingredients were unnecessary.

Coenzyme Q Definitions and Biosynthetic Pathway:

The term coenzyme Q refers to a series of related 2-3-dimethoxy-5-methyl-benzoquinones (i.e., known as $CoQ_6$, $CoQ_7$, $CoQ_8$, $CoQ_9$ and $CoQ_{10}$) with a polyisoprenoid side chain in the 6-position that are widely distributed in animals, plants and microorganisms. The quinones of the CoQ series found in various biological species differ only slightly in chemical structure based on the length of the hydrocarbon tail and which facilitates CoQ's localization in mitochondrial or cytoplasmic membranes. Differences in properties are due to the differences in length of the side chain.

Figure 3A:
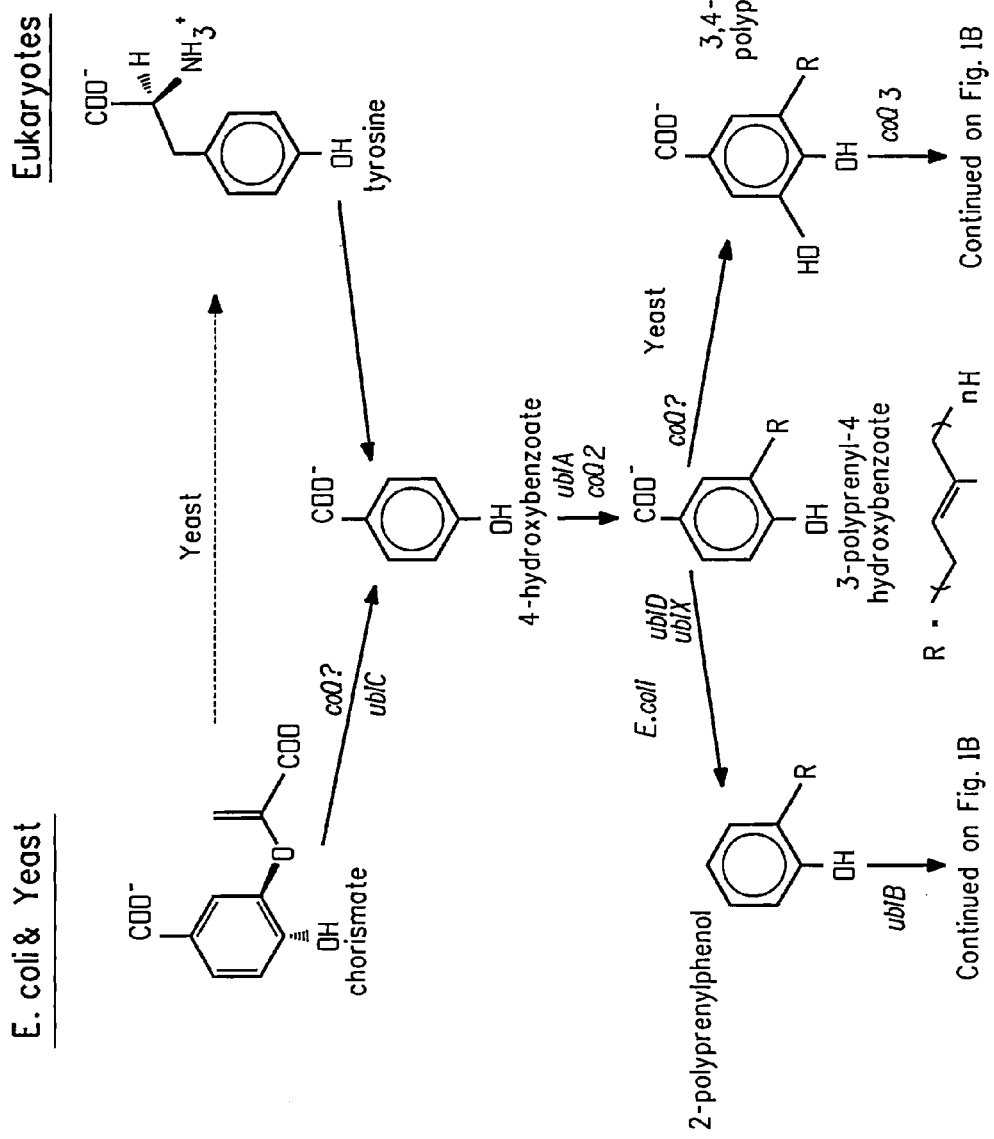
FIGS. 3A and 3B illustrate the CoQ biosynthetic pathway.
Figure 3B:
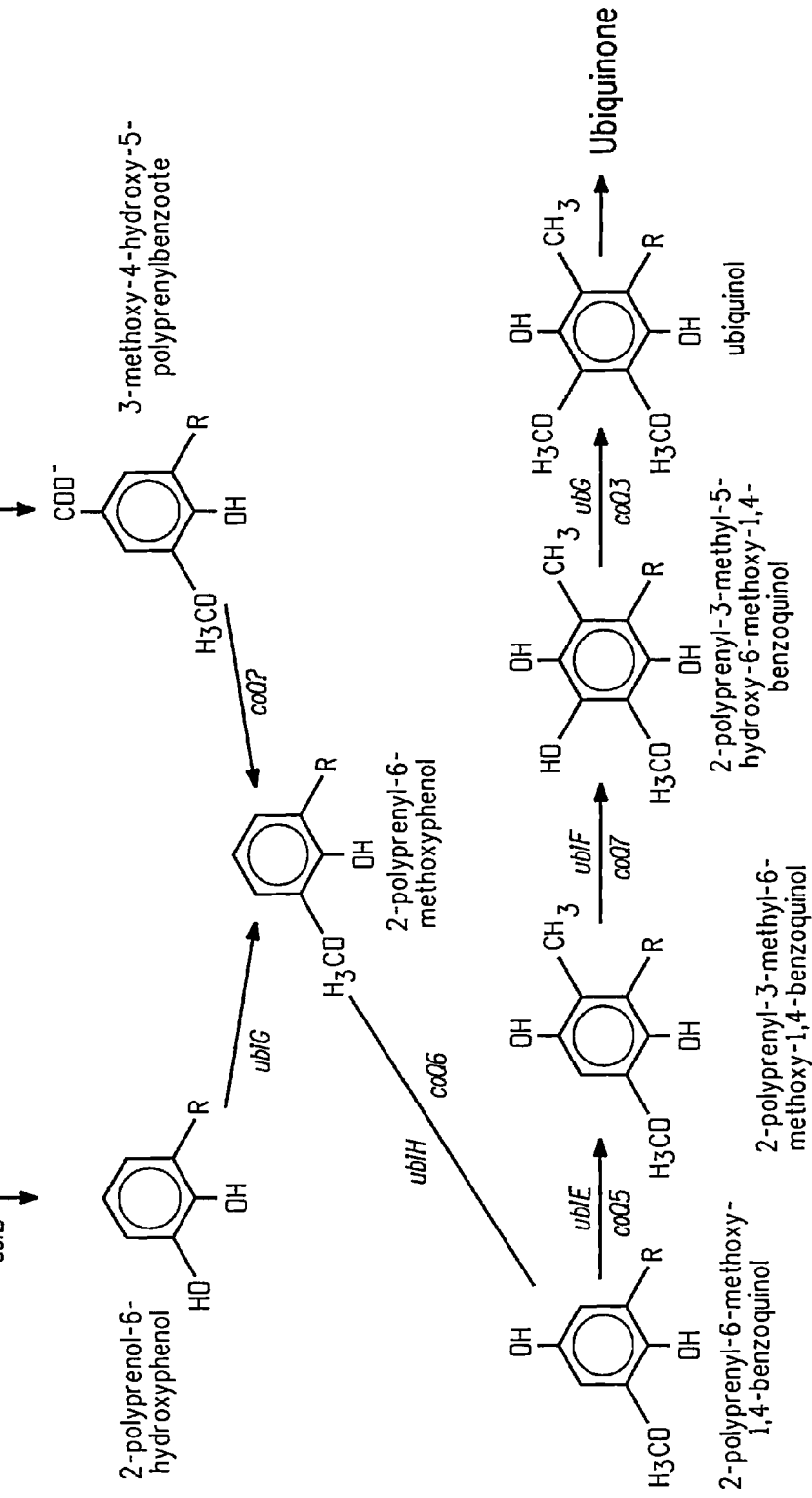

The biochemical reactions that lead to production of $CoQ_6$, $CoQ_7$, $CoQ_8$, $CoQ_9$ and $CoQ_{10}$ are well-described in the minireview of R. Meganathan (*FEMS Microbiol. Lett.*, 203: 131-139 (2001)) for *Escherichia coli* and *Saccharomyces cerevisiae* and are summarized in FIGS. 3A and 3B herein. In brief, the quinonoid nucleus is derived from the shikimate pathway via chorismate or tyrosine. Formation of 4-hydroxybenzoate is the first committed step in the biosynthesis of CoQ. This molecule then undergoes prenylation, wherein the polyprenyl side chain of the final CoQ enzyme is added.

Prenylation:

The polyprenyl side chain itself is formed via the mevalonate pathway, which results in the formation of the $C_{15}$ unit FPP from the starting precursor, acetyl-CoA (as previously described supra). FPP then reacts with a prenyl diphosphate synthase, to produce the final polyprenyl side chain having from 30-50 carbon atoms (corresponding to 6, 7, 8, 9 or 10 isoprenoid units in the side chain). The precise length of the polyprenyl side chain present in a particular organism is constant and is determined by the nature of the prenyl diphosphate synthase.

More specifically, the term "prenyl diphosphate synthase" is used as a general term for those enzymes which catalyze a condensation reaction that polymerizes prenyl diphosphate (an allylic primer) and IPP to produce polyprenyl diphosphate. This class of genes is divided into 2 types, based on whether the condensation reaction of IPP is cis-[or (Z)-chain] elongation or trans-[or (E)-chain] elongation. Bacterial prenyl diphosphate synthases are classified into the following four groups: (1) Prenyl diphosphate synthase I comprising E type, short chain prenyl diphosphate synthases such as geranyl diphosphate synthase (catalyzing a $C_5 \rightarrow C_{10}$ reaction), farnesyl diphosphate synthase (catalyzing a $C_5 \rightarrow C_{15}$ reaction) and geranylgeranyl diphosphate synthase (catalyzing a $C_5 \rightarrow C_{20}$ reaction); (2) Prenyl diphosphate synthase II comprising E type, medium chain prenyl diphosphate synthases such as hexaprenyl diphosphate synthase (HexPP; catalyzing a $C_{15} \rightarrow C_{30}$ reaction) and heptaprenyl diphosphate synthase (HepPP; catalyzing a $C_{15} \rightarrow C_{35}$ reaction); (3) Prenyl diphosphate synthase III comprising E type, long chain prenyl diphosphate synthases such as octaprenyl diphosphate synthase (OctPP; catalyzing a $C_{15} \rightarrow C_{40}$ reaction), solanesyl [or nonaprenyl] diphosphate synthase (SPP or NonPP; catalyzing a $C_{15} \rightarrow C_{45}$ reaction) and decaprenyl diphosphate synthase (DecPP; catalyzing a $C_{15} \rightarrow C_{50}$ reaction); and (4) Prenyl diphosphate synthase IV comprising Z type, long chain prenyl diphosphate synthases such as Z-nonaprenyl diphosphate synthase (catalyzing a $C_{15} \rightarrow C_{45}$ reaction), undecaprenyl diphosphate synthase (UPP; catalyzing a $C_{15} \rightarrow C_{55}$ reaction) and dehydrodolichyl diphosphate synthase (deDoIPP; catalyzing a $C_{15} \rightarrow C_{85-105}$ reaction) (reviewed in Szkopińska, A., *Acta Biochimica Polonica*, 47 (2):469-480 (2000)).

Subsequent Ring Modifications:

Prenylation results in the formation of 3-polyprenyl-4-hydroxybenzoate. This molecule then undergoes multiple ring modifications (including hydroxylation, methylation and decarboxylation) to result in formation of ubiquinol, which is non-enzymatically converted to ubiquinone (i.e., CoQ).

A "functional" CoQ biosynthetic pathway thus necessarily requires at least one gene encoding a phenyl diphosphate synthase that is expressed as an active enzyme and which therefore results in production of $CoQ_6$, $CoQ_7$, $CoQ_8$, $CoQ_9$ and/or $CoQ_{10}$.

Genetically Engineered Oleaginous Yeast for CoQ Production:

The wildtype oleaginous yeast *Yarrowia lipolytica* contains all of the genes required for $CoQ_9$ production (producing at least about 2000 ppm under typical growth conditions) (Example 15). Analysis of the microbial biomass indicates that the concentration of $CoQ_9$ therein may be sufficient to reduce and/or eliminate the need to the microbial biomass/oils (and any products contained therein e.g., carotenoids, PUFAs) with additional antioxidants.

Means to increase production of $CoQ_9$ in this organism would likely require genetic manipulation. However, the genes required for CoQ biosynthesis in *Yarrowia lipolytica* have not been extensively characterized. Despite this, based on the complete sequencing of the entire genome (Dujon, B. et al., *Nature*, 430 (6995):35-44 (2004)) and the public *Y. lipolytica* protein database of the "Yeast project Genolevures" (Center for Bioinformatics, LaBRI, Talence Cedex, France), one skilled in the art would readily be able to identify homologous genes corresponding to the ubiC, ubiA, ubiD, ubiX, ubiB, ubiG, ubiH, ubiE and ubiF genes of *Escherichia coli* and/or the coq2, coq3, coq6, coq5 and coq7 genes of *Saccharomyces cerevisiae*, which are known to catalyze the reactions diagrammed in FIGS. 3A and 3B. Similarly, the initial and intermediate genes of the mevalonate pathway responsible for the biosynthesis of the polyprenyl side chain of $CoQ_9$ should also easily be identified (up to and including FPP synthase). The last gene required for synthesis of the polyprenyl side chain of *Yarrowia lipolytica*'s $CoQ_9$ is a SPP, which has not yet been identified or characterized. One of skill in the art would be able to devise a means to up-regulate genes that enable $CoQ_9$ production, following identification of the appropriate genes.

Production of alternate molecules of the CoQ series (i.e., $CoQ_6$, $CoQ_7$, $CoQ_8$ or $CoQ_{10}$) would require disruption of the native SPP and expression of a heterologous HexPP, HepPP, OctPP or DecPP (see, for example, U.S. Patent Application No. 60/991,266 (filed Nov. 30, 2007), which describes means to engineer $CoQ_{10}$ production in *Yarrowia lipolytica*). Studies summarized in Meganathan (supra) have demonstrated that mutant bacteria and yeast expressing a non-native prenyl diphosphate synthase that results in a side chain of different length than in the parent do not affect the mutant strain.

Genetically Engineered Oleaginous Yeast for Carotenoid and CoQ Production:

In one embodiment the present invention encompasses a recombinant oleaginous yeast production host for the production of carotenoids and an additional antioxidant comprising:

a.) a functional carotenoid biosynthetic pathway, wherein expression of said carotenoid biosynthetic pathway results in the production of at least one carotenoid selected from the group consisting of: lycopene, β-carotene, canthaxanthin, zeaxanthin, lutein and astaxanthin; and, b.) a functional CoQ biosynthetic pathway, wherein expression of said CoQ biosynthetic pathway results in the production of a CoQ selected from the group consisting of $CoQ_6$, $CoQ_7$, $CoQ_8$, $CoQ_9$ and $CoQ_{10}$;

wherein said oleaginous yeast produces at least about 25 wt % of its dcw as oil.

The CoQ produced by *Yarrowia lipolytica* and derivatives thereof during fermentation is typically in a substantially reduced state. As used herein, "substantially reduced form of CoQ" or "substantially reduced" refers a condition where the majority of the CoQ present in a composition is in the reduced form. In one aspect, substantially reduced refers to a condition where at least about 50% of the CoQ (percentage based on total CoQ present) in a composition is in the reduced state, preferably at least about 70-80% is in the reduced form, more preferably at least about 80-90% is in the reduced form and even more preferably at least about 90-98% is in the reduced form.

Similarly, the invention comprises a method to produce a pigmented oleaginous yeast biomass comprising a carotenoid and an additional antioxidant, comprising: a.) providing the recombinant production host described above, wherein said production host accumulates at least 25 wt % of its dcw as oil and wherein said product host comprises a functional carotenoid biosynthetic pathway and a functional CoQ biosynthetic pathway; and, b.) culturing the recombinant production host under suitable conditions whereby pigmented oleaginous yeast biomass is produced comprising a carotenoid and an additional antioxidant selected from the group consisting of $CoQ_6$, $CoQ_7$, $CoQ_8$, $CoQ_9$ and $CoQ_{10}$.

In preferred embodiments, the oleaginous yeast is a recombinant strain of *Yarrowia lipolytica* that has the natural ability to produce $CoQ_9$ (i.e., the pathway is not genetically engineered). Upon transformation with a functional carotenoid biosynthetic pathway using the methodology described previously, the resultant recombinant yeast will co-produce carotenoids and $CoQ_9$.

In alternate preferred embodiments, the oleaginous yeast is engineered to produce $CoQ_{10}$ (preferably at least about 0.0001%-0.01% of the total dcw, and more preferably at least about 0.01%-1% of the total dcw), prior to transformation with a functional carotenoid biosynthetic pathway.

Figure 4:
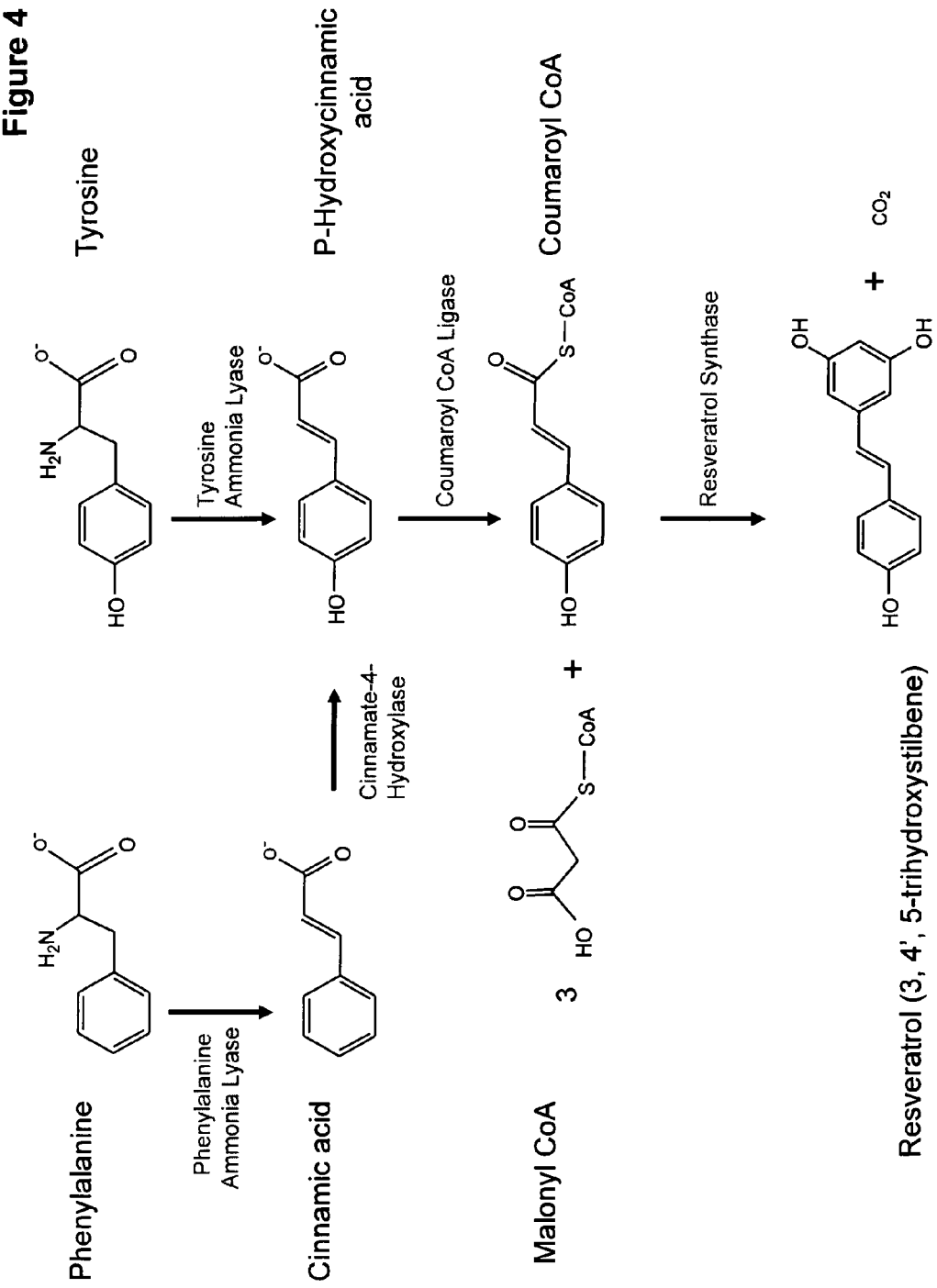
FIG. 4 illustrates the resveratrol biosynthetic pathway.

Resveratrol Definitions And Biosynthetic Pathway:

Production of resveratrol (trans-3,4',5-trihydroxystilbene) in *Yarrowia lipolytica* has been reported (U.S. patent application Ser. No. 11/436,182. Specifically, a recombinant host cell producing significant quantities of the antioxidant was created by introducing several genes from the phenylpropanoid pathway in combination with a suitable gene encoding resveratrol synthase (FIG. 4). A resveratrol synthase is a type III polyketide synthase (E. C. 2.3.1.95) that condenses one molecule of p-coumaroyl CoA with 3 molecules of malonyl CoA to produce 1 molecule of resveratrol. This, in combination with the natural ability of the oleaginous host cell to produce a suitable amount of malonyl CoA, enabled production of resveratrol.

More specifically, suitable combinations of genes from the phenylpropanoid pathway were selected from the following: 1.) at least one gene encoding a "tyrosine ammonia lyase" or "TAL" (EC 4.3.1.-) that catalyzes the direct conversion of tyrosine to p-hydroxycinnamic acid (pHCA) and at least one gene encoding a "coumaroyl CoA ligase" (E.C. 6.2.1.12), to enable conversion of pHCA into p-coumaroyl CoA; 2.) at least one gene encoding a "phenylalanine ammonia-lyase" or "PAL" (E.C. 4.3.1.5) that catalyzes the conversion of phenylalanine to trans-cinnamic acid, at least one gene encoding a "cinnamate 4-hydroxylase" (E.C. 1.14.13.11) that converts trans-cinnamic acid to pHCA, and at least one gene encoding a coumaroyl CoA ligase; 3.) at least one gene encoding a "phenylalanine/tyrosine ammonia lyase" or "PAL/TAL" (EC 4.3.1.-), wherein the enzyme has both PAL activity and TAL activity to thereby convert phenylalanine to trans-cinnamic acid and tyrosine to pHCA, at least one gene encoding a coumaroyl CoA ligase, and optionally at least one gene encoding a cinnamate 4-hydroxylase.

Although there are many sources for each of the genes in the resveratrol biosynthesis pathway, as exemplified in PCT Publication No. WO 2006/125000, a resveratrol synthase from *Vitis* sp., a coumaroyl CoA ligase from *Streptomyces coelicolor* (GenBank® Accession No. AL939119), and a PAL (having some TAL activity) from *Rhodotorula glutinis* (GenBank® Accession No. X12702) were each codon optimized and recombinantly expressed in *Yarrowia lipolytica*, resulting in the production of resveratrol. Genes encoding the enzymes phenylalanine hydroxylase, acetyl CoA carboxylase, and β-glucosidase could also be engineered into the recombinant host for increased resveratrol production.

Genetically Engineered Oleaginous Yeast for Carotenoid and Resveratrol Production:

In one embodiment the present invention encompasses a recombinant oleaginous yeast production host for the production of carotenoids and resveratrol comprising:
  a.) a functional carotenoid biosynthetic pathway, wherein expression of said carotenoid biosynthetic pathway results in the production of at least one carotenoid selected from the group consisting of: lycopene, β-carotene, canthaxanthin, zeaxanthin, lutein and astaxanthin; and,
  b.) a functional phenylpropanoid biosynthetic pathway, wherein expression of said phenylpropanoid biosynthetic pathway results in the production of coumaroyl CoA; and,
  c.) a functional resveratrol synthase, wherein expression of said gene results in the conversion of coumaroyl CoA to resveratrol;
wherein said oleaginous yeast produces at least about 25 wt % of its dcw as oil.

Similarly, the invention comprises a method to produce a pigmented oleaginous yeast biomass comprising a carotenoid compound and resveratrol, comprising: a.) providing the recombinant production host described above, wherein said production host accumulates at least 25 wt % of its dcw as oil and wherein said production host comprises a functional carotenoid biosynthetic pathway and a functional biosynthetic pathway for resveratrol production (i.e., comprising a functional phenylpropanoid biosynthetic pathway as described above and a resveratrol synthase); and, b.) culturing the recombinant production host under suitable conditions whereby pigmented oleaginous yeast biomass is produced comprising a carotenoid and resveratrol.

In preferred embodiments, the oleaginous yeast is a recombinant strain of *Yarrowia lipolytica* that has been previously engineered for high-level production of resveratrol, via expression of a PAL/TAL, a coumaroyl CoA ligase, and a resveratrol synthase. Upon transformation with a functional carotenoid biosynthetic pathway using the methodology described previously, the resultant recombinant yeast will co-produce carotenoids and at least 0.01 wt % resveratrol and/or resveratrol glucoside.

Genetically Engineered Oleaginous Yeast for Carotenoid, PUFA and Antioxidant Production The invention provides recombinant oleaginous yeast able to produce carotenoids, and $C_{40}$ carotenoids in particular. The yeast is effectively transformed with the genetic elements of the $C_{40}$ carotenoid biosynthetic pathway as described herein, wherein Crt enzymes of particular usefulness include, but are not limited to phytoene synthase (crtB), phytoene desaturase (crtI), lycopene cyclase (crtY), carotenoid hydroxylase (crtZ), a carotenoid ketolase (crtW) and a carotenoid ε-hydroxylase (lut1). Carotenoids of particular relevance in the present invention include but are not limited to: lycopene, β-carotene, zeaxanthin, lutein, canthaxanthin and astaxanthin.

Similarly, the same host expressing various crt genes may also be engineered to express PUFA biosynthetic pathways as described herein. PUFAs of particular interest in the present invention are ω-3 PUFAs including ALA, STA, ETrA, ETA, EPA, DPA and DHA and ω-6 PUFAs including LA, GLA, EDA, DGLA and ARA. PUFA synthesis may take many paths but generally utilizes enzymes selected from the group consisting of desaturases (e.g., Δ4, Δ5, Δ6, Δ8, Δ9, Δ12, Δ15, Δ17 desaturases) and elongases (e.g., Δ9 elongases and $C_{14/16}$, $C_{16/18}$, $C_{18/20}$ and $C_{20/22}$ elongases).

Similarly, the same host expressing various crt genes and PUFA biosynthetic genes may also be engineered to express additional antioxidant biosynthetic pathways as described herein. Antioxidants of particular interest in the present invention are those of the CoQ series and resveratrol. Resveratrol biosynthesis preferentially requires expression of a PAL/TAL, a coumaroyl CoA ligase, and a resveratrol synthase, while coenzyme Q biosynthesis requires expression of a prenyl diphosphate synthase (e.g., HexPP, HepPP, OctPP, SPP or DecPP).

These host may be genetically engineered using methods well known in the art.

Microbial Expression Systems, Cassettes & Vectors, and Transformation

Microbial expression systems and expression vectors containing regulatory sequences that direct high level expression of foreign proteins are well known to those skilled in the art. Any of these could be used to construct chimeric genes for production of the desired compound(s) (i.e., carotenoids and optionally PUFAs and/or additional antioxidants). These chimeric genes could then be introduced into appropriate microorganisms via transformation to allow for high level expression of the enzymes.

Vectors (e.g., constructs, plasmids) and DNA expression cassettes useful for the transformation of suitable host cells are well known in the art. The specific choice of sequences present in the construct is dependent upon the desired expression products (supra), the nature of the host cell, and the proposed means of separating transformed cells versus non-transformed cells. Typically, however, the vector contains at least one expression cassette, a selectable marker and sequences allowing autonomous replication or chromosomal integration. Suitable expression cassettes comprise a region 5' of the gene that controls transcriptional initiation (e.g., a promoter), the gene coding sequence, and a region 3' of the DNA fragment that controls transcriptional termination (i.e., a terminator). It is most preferred when both control regions are derived from genes from the transformed host cell, although it is to be understood that such control regions need not be derived from the genes native to the specific species chosen as a production host.

Initiation control regions or promoters, which are useful to drive expression of the relevant genes in the desired yeast host cell are numerous and familiar to those skilled in the art. Virtually any promoter capable of directing expression of these genes in the selected host cell is suitable for the present invention. Expression in a host cell can be accomplished in a transient or stable fashion. Transient expression can be accomplished by inducing the activity of a regulatable promoter operably linked to the gene of interest. Stable expression can be achieved by the use of a constitutive promoter operably linked to the gene of interest. As an example, when the host cell is yeast, transcriptional and translational regions functional in yeast cells are provided, particularly from the host species (e.g., see U.S. Pat. No. 7,238,482 and PCT Publication No. WO 2006/052870 [U.S. Publication 2006-0115881-A1] for preferred transcriptional initiation regulatory regions for use in Yarrowia lipolytica). Any one of a number of regulatory sequences can be used, depending upon whether constitutive or induced transcription is desired, the efficiency of the promoter in expressing the ORF of interest, the ease of construction and the like.

Nucleotide sequences surrounding the translational initiation codon 'ATG' have been found to affect expression in yeast cells. If the desired polypeptide is poorly expressed in yeast, the nucleotide sequences of exogenous genes can be modified to include an efficient yeast translation initiation sequence to obtain optimal gene expression. For expression in yeast, this can be done by site-directed mutagenesis of an inefficiently expressed gene by fusing it in-frame to an endogenous yeast gene, preferably a highly expressed gene. Alternatively, as demonstrated in Yarrowia lipolytica, one can determine the consensus translation initiation sequence in the host and engineer this sequence into heterologous genes for their optimal expression in the host of interest (U.S. Pat. No. 7,125,672).

Termination control regions may be derived from various genes native to the preferred hosts. Optionally, a termination site may be unnecessary; however, it is most preferred if included. As used herein, the termination region can be derived from the 3' region of the gene from which the initiation region was obtained or from a different gene. A large number of termination regions are known and function satisfactorily in a variety of hosts (when utilized both in the same and different genera and species from where they were derived). Typically, the termination region usually is selected more as a matter of convenience rather than because of any particular property. For the purposes herein, wherein the host cell is an oleaginous yeast, the termination region is preferably derived from a yeast gene, particularly Saccharomyces, Schizosaccharomyces, Candida, Yarrowia or Kluyveromyces. The 3'-regions of mammalian genes encoding γ-interferon and α-2 interferon are also known to function in yeast. Although not intended to be limiting, preferred termination regions useful in the disclosure herein include: ~100 bp of the 3' region of the Yarrowia lipolytica extracellular protease (Xpr, GenBank® Accession No. M17741); the acyl-CoA oxidase (Aco3: GenBank® Accession No. AJ001301 and No. CAA04661; Pox3: GenBank® Accession No. XP_503244) terminators; the Pex20 (GenBank® Accession No. AF054613) terminator; the Pex16 (GenBank® Accession No. U75433) terminator; the Lip1 (GenBank® Accession No. Z50020) terminator; the Lip2 (GenBank® Accession No. AJ012632) terminator; and the 3-oxoacyl-coA thiolase (Oct; GenBank® Accession No. X69988) terminator.

Merely inserting a gene into a cloning vector does not ensure that it will be successfully expressed at the level needed. In response to the need for a high expression rate, many specialized expression vectors have been created by manipulating a number of different genetic elements that control aspects of transcription, translation, protein stability, oxygen limitation and secretion from the microbial host cell. More specifically, some of the molecular features that have been manipulated to control gene expression include: 1.) the nature of the relevant transcriptional promoter and terminator sequences; 2.) the number of copies of the cloned gene and whether the gene is plasmid-borne or integrated into the genome of the host cell; 3.) the final cellular location of the synthesized foreign protein; 4.) the efficiency of translation and correct folding of the protein in the host organism; 5.) the intrinsic stability of the mRNA and protein of the cloned gene within the host cell; and, 6.) the codon usage within the cloned gene, such that its frequency approaches the frequency of preferred codon usage of the host cell. Each of these types of modifications are encompassed in the present invention, as means to further optimize expression of the crt genes (and optionally the PUFA biosynthetic pathway genes and/or anti-oxidant biosynthetic pathway genes) required herein. Methods of codon-optimizing foreign genes for optimal expression in Yarrowia lipolytica are set forth in U.S. Pat. No. 7,125,672.

Once the DNA encoding a polypeptide suitable for expression in an appropriate microbial host cell (e.g., oleaginous yeast) has been obtained (e.g., a chimeric gene comprising a promoter, ORF and terminator), it is placed in a plasmid vector capable of autonomous replication in a host cell, or it is directly integrated into the genome of the host cell. Integration of expression cassettes can occur randomly within the host genome or can be targeted through the use of constructs containing regions of homology with the host genome sufficient to target recombination within the host locus. Where constructs are targeted to an endogenous locus, all or some of the transcriptional and translational regulatory regions can be provided by the endogenous locus.

Constructs comprising a coding region of interest may be introduced into a host cell by any standard technique. These techniques include transformation (e.g., lithium acetate transformation [Guthrie, C., Methods in Enzymology, 194:186-187 (1991)]), protoplast fusion, biolistic impact, electroporation, microinjection, or any other method that introduces the gene of interest into the host cell. More specific teachings applicable for oleaginous yeast (i.e., Yarrowia lipolytica) include U.S. Pat. Nos. 4,880,741 and 5,071,764 and Chen, D. C. et al. (Appl. Microbiol. Biotechnol., 48 (2):232-235 (1997)).

In the present invention, the preferred method of expressing genes in Yarrowia lipolytica is by integration of linear DNA into the genome of the host; and, integration into multiple locations within the genome can be particularly useful when high level expression of genes are desired. For example, preferred loci for integration include: the Ura3 locus (GenBank® Accession No. AJ306421), the Leu2 gene locus (GenBank® Accession No. AF260230), the Lys5 gene (GenBank® Accession No. M34929), the Aco2 gene locus (GenBank® Accession No. AJ001300), the Pox3 gene locus (Pox3: GenBank® Accession No. XP_503244; or, Aco3: GenBank® Accession No. AJ001301), the Δ12 desaturase gene locus (U.S. Pat. No. 7,214,491), the Lip1 gene locus (GenBank® Accession No. Z50020), the Lip2 gene locus (GenBank® Accession No. AJ012632) and/or the Pex10 gene locus (GenBank® Accession No. CAG81606).

Where two or more genes are expressed from separate replicating vectors, it is desirable that each vector has a different means of selection and should lack homology to the other construct(s) to maintain stable expression and prevent reassortment of elements among constructs. Judicious choice of regulatory regions, selection means and method of propagation of the introduced construct(s) can be experimentally determined so that all introduced genes are expressed at the necessary levels to provide for synthesis of the desired products.

For convenience, a host cell that has been manipulated by any method to take up a DNA sequence (e.g., an expression cassette) will be referred to as "transformed" or "recombinant" herein. The transformed host will have at least one copy of the expression construct and may have two or more, depending upon whether the gene is integrated into the genome, amplified, or is present on an extrachromosomal element having multiple copy numbers.

The transformed host cell can be identified by various selection techniques, as described in U.S. Pat. No. 7,238,482 and PCT Publication No. WO 2006/052870 [U.S. Publication 2006-0115881-A1]. Preferred selection methods for use herein are resistance to kanamycin, hygromycin and the amino glycoside G418, as well as ability to grow on media lacking uracil, leucine, lysine, tryptophan or histidine. In alternate embodiments, 5-fluoroorotic acid (5-fluorouracil-6-carboxylic acid monohydrate; "5-FOA") is used for selection of yeast Ura⁻ mutants. The compound is toxic to yeast cells that possess a functioning URA3 gene encoding orotidine 5'-monophosphate decarboxylase (OMP decarboxylase); thus, based on this toxicity, 5-FOA is especially useful for the selection and identification of Ura⁻ mutant yeast strains (Bartel, P. L. and Fields, S., Yeast 2-Hybrid System, Oxford University: New York, v. 7, pp 109-147, 1997). More specifically, one can first knockout the native Ura3 gene to produce a strain having a Ura– phenotype, wherein selection occurs based on 5-FOA resistance. Then, a cluster of multiple chimeric genes and a new Ura3 gene can be integrated into a different locus of the *Yarrowia* genome to thereby produce a new strain having a Ura+ phenotype. Subsequent integration produces a new Ura3– strain (again identified using 5-FOA selection), when the introduced Ura3 gene is knocked out. Thus, the Ura3 gene (in combination with 5-FOA selection) can be used as a selection marker in multiple rounds of transformation.

An alternate preferred selection method utilized herein relies on a dominant, non antibiotic marker for *Yarrowia lipolytica* based on sulfonylurea resistance (see PCT Publication No. WO 2006/052870 for additional details). The technique is also generally applicable to other industrial yeast strains that may be haploid, diploid, aneuploid or heterozygous. Specifically, the sulfonylurea resistance selection marker utilized herein for transforming *Y. lipolytica* does not rely on a foreign gene but on a mutant native gene. Thus, it neither requires auxotrophy nor results in auxotrophy and allows transformation of wild type strains. More specifically, the marker gene (SEQ ID NO:1) is a native acetohydroxyacid synthase (AHAS or acetolactate synthase; E.C. 4.1.3.18) that has a single amino acid change (W497L) that confers sulfonyl urea herbicide resistance.

An additional method for recycling a selection marker relies on site-specific recombinase systems. Briefly, the site-specific recombination system consists of two elements: (1) a recombination site having a characteristic DNA sequence [e.g., LoxP]; and, (2) a recombinase enzyme that binds to the DNA sequence specifically and catalyzes recombination (i.e., excision) between DNA sequences when two or more of the recombination sites are oriented in the same direction at a given interval on the same DNA molecule [e.g., Cre]. This methodology has utility as a means of selection, since it is possible to "recycle" a pair of preferred selection markers for their use in multiple sequential transformations.

Specifically, an integration construct is created comprising a target gene that is desirable to insert into the host genome (e.g., a crt gene), as well as a first selection marker (e.g., ura) that is flanked by recombination sites. Following transformation and selection of the transformants, the first selection marker is excised from the chromosome by the introduction of a replicating plasmid carrying a second selection marker (e.g., sulfonylurea resistance [AHAS]) and a recombinase suitable to recognize the site-specific recombination sites introduced into the genome. Upon selection of those transformants carrying the second marker and confirmation of excision of the first selection marker from the host genome, the replicating plasmid is then cured from the host in the absence of selection. This produces a transformant that possesses neither the first nor second selection marker, and thus the cured strain is available for another round of transformation. One skilled in the art will recognize that the methodology is not limited to the particular selection markers or site-specific recombination system used in the present invention.

Methods for manipulating biochemical pathways are well known to those skilled in the art; and, it is expected that numerous manipulations will be possible to maximize carotenoid production (and optionally PUFAs and/or additional antioxidants) in oleaginous yeasts, and particularly, in *Yarrowia lipolytica*. This may require metabolic engineering directly within the $C_{40}$ carotenoid, PUFA and/or CoQ/resveratrol biosynthetic pathways or additional coordinated manipulation of various other metabolic pathways.

Microbial Fermentation Processes

The transformed microbial host cell is grown under conditions that optimize expression of chimeric genes and produce the greatest and the most economical yield of desired carotenoids (and optionally PUFAs and/or additional antioxidants). In general, media conditions that may be optimized include the type and amount of carbon source, the type and amount of nitrogen source, the carbon-to-nitrogen ratio, the oxygen level, growth temperature, pH, length of the biomass production phase, length of the oil accumulation phase and the time and method of cell harvest. Microorganisms of interest, such as oleaginous yeast (e.g., *Yarrowia lipolytica*) are generally grown in complex media (e.g., yeast extract-peptone-dextrose broth (YPD)) or a defined minimal media that lacks a component necessary for growth and thereby forces selection of the desired expression cassettes (e.g., Yeast Nitrogen Base (DIFCO Laboratories, Detroit, Mich.)).

Fermentation media in the present invention must contain a suitable carbon source. Suitable carbon sources are taught in U.S. Pat. No. 7,238,482. Although it is contemplated that the source of carbon utilized in the present invention may encompass a wide variety of carbon-containing sources, preferred carbon sources are sugars, glycerol and/or fatty acids. Most preferred is glucose and/or fatty acids containing between 10-22 carbons.

Nitrogen may be supplied from an inorganic (e.g., $(NH_4)_2SO_4$) or organic (e.g., urea or glutamate) source. In addition to appropriate carbon and nitrogen sources, the fermentation media must also contain suitable minerals, salts, cofactors, buffers, vitamins and other components known to those skilled in the art suitable for the growth of the oleaginous host and promotion of the enzymatic pathways necessary for carotenoid production (and optionally PUFAs and/or CoQ/resveratrol). Particular attention is given to several metal ions (e.g., $Mn^{+2}$, $Co^{+2}$, $Zn^{+2}$, $Mg^{+2}$) that promote synthesis of lipids and PUFAs (Nakahara, T. et al., *Ind. Appl. Single Cell Oils*, D. J. Kyle and R. Colin, eds. pp 61-97 (1992)).

Preferred growth media in the present invention are common commercially prepared media, such as Yeast Nitrogen Base (DIFCO Laboratories, Detroit, Mich.). Other defined or synthetic growth media may also be used and the appropriate medium for growth of the transformant host cells will be known by one skilled in the art of microbiology or fermentation science. A suitable pH range for the fermentation is typically between about pH 4.0 to pH 8.0, wherein pH 5.5 to pH 7.5 is preferred as the range for the initial growth conditions. The fermentation may be conducted under aerobic or anaerobic conditions, wherein microaerobic conditions are preferred.

Typically, accumulation of high levels of carotenoids (and optionally PUFAs and/or additional antioxidants) in oleaginous yeast cells requires a two-stage process, since the metabolic state must be "balanced" between growth and synthesis/storage of fats. Thus, for example, a two-stage fermentation process is preferred for the production of EPA in *Yarrowia lipolytica*. This approach is described in U.S. Pat. No. 7,238,482, as are various suitable fermentation process designs (i.e., batch, fed-batch and continuous) and considerations during growth.

Purification and Processing of Carotenoids, PUFAs and/or Antioxidants

In one embodiment, the primary product is oleaginous yeast biomass. As such, isolation and purification of the carotenoid-containing oils (including those comprising PUFAs and antioxidants) from the biomass may not be necessary (i.e., wherein the biomass is the product).

However, certain end uses and/or product forms may require partial and/or complete isolation/purification of the carotenoid-containing oil (optionally comprising PUFAs and antioxidants) from the biomass, to result in partially purified biomass, purified oil, and/or purified carotenoids. Given the lipophilic/hydrophobic nature of carotenoids (which are therefore expected to accumulate in oil bodies within the recombinant oleaginous yeast), many techniques applied to isolate/purify microbially produced oils/PUFAs should work to isolate carotenoids as well, especially when the desired product is a pigmented oil. As such, any number of well known techniques can be used to isolate the compounds from the biomass including, but not limited to: extraction (e.g., U.S. Pat. No. 6,797,303 and No. 5,648,564) with organic solvents, sonication, supercritical fluid extraction (e.g., using carbon dioxide), saponification and physical means such as presses, or combinations thereof. One is referred to the teachings of U.S. Pat. No. 7,238,482 for additional details.

One review of PUFA extraction techniques, quality analysis and acceptability standards for yeast lipids is that of Z. Jacobs (*Critical Reviews in Biotechnology*, 12 (5/6):463-491 (1992)). A brief review of downstream processing is also available by A. Singh and O. Ward (*Adv. Appl. Microbiol.*, 45:271-312 (1997)).

Finally, one skilled in the art will be aware of the appropriate means to selectively purify a specific carotenoid from a carotenoid-containing mixture comprising various carotenoid intermediates in addition to the desired carotenoid.

Use of Compositions Comprising Carotenoids

The carotenoids produced by the present processes may be used as pigments, antioxidants, or as both in various commercial products (described infra).

In alternate embodiments, it is useful to engineer an oleaginous microorganism to simultaneously produce one of the following: 1.) both carotenoids and at least one ω-3/ω-6 PUFA [preferably selected from the group consisting of LA, EDA, GLA, DGLA, ARA, ALA, STA, ETrA, ETA, EPA, DPA and DHA]; 2.) both carotenoids and at least one additional antioxidant [preferably selected from the group consisting of $CoQ_6$, $CoQ_7$, $CoQ_3$, $CoQ_9$, $CoQ_{10}$ and resveratrol]; and, 3.) carotenoids and at least one ω-3/ω-6 PUFA and at least one additional antioxidant. Any of the above combinations of products are expected to create a higher value product or reduce production costs. This would thereby avoid the situation that a commercial product formulator must typically face, wherein carotenoids and PUFAs and/or additional antioxidants are obtained from a variety of sources and then must be formulated into a final product that contains an effective amount of each ingredient (as the composition, purity and source of each ingredient may vary, the final product formulation may require significant monitoring and/or processing to obtain the desired product specifications).

The present oleaginous yeast biomass comprising at least one carotenoid (and optionally at least one ω-3/ω-6 PUFA and/or at least one additional antioxidant) can be prepared and sold in a variety of product forms including, but not limited to whole cell biomass, partially purified biomass, purified oil comprising carotenoid, and purified carotenoid. The product form will depend upon the targeted end use. For ease of discussion, the term "microbial biomass/oils" will refer to any of the above product forms.

In some embodiments, the present invention is drawn to "pigmented microbial biomass/oils", wherein the term pigmented microbial biomass/oils refers to a microbial biomass/oil of the invention comprising at least one carotenoid (and optionally at least one PUFA and/or at least one additional antioxidant), wherein the carotenoid is present in an "effective" amount such that the final product and/or product formulation within which the pigmented microbial biomass/oil is incorporated becomes effectively pigmented. One of skill in the art of processing and formulation will understand how the amount and composition of the pigmented microbial biomass/oils may be added to the product and/or product formulation and how the "effective" amount will depend according to target species and/or end use (e.g., the food or feed product, cosmetic or personal care product, supplement, etc.). For example, an "effective amount of pigment" with respect to an animal feed refers to an amount that effectively pigments at least one animal tissue (e.g., chicken products such as egg yolks; crustacean muscle tissue and/or shell tissue; fish muscle tissue and/or skin tissue, etc.) under feeding conditions considered suitable for growth of the target animal species. The amount of pigment incorporated into the animal feed may vary according to target species. Typically, the amount of pigment product incorporated into the feed product takes into account pigmentation losses associated with feed processing conditions, typical handling and storage conditions, the stability of the pigment in the feed, the bioavailability/bioabsorption efficiency of the particular species, the pigmentation rate of the animal tissue targeted for pigmentation, and the overall profile of pigment isomers (wherein some are preferentially absorbed over others), to name a few.

In alternate embodiments, the present invention is drawn to stabilized microbial biomass/oils, wherein the term "stabilized microbial biomass/oils" refers herein to a microbial biomass/oil comprising carotenoids (and optionally comprising at least one ω-3/ω-6 PUFA and/or at least one additional antioxidant [e.g., a CoQ, resveratrol]), wherein the carotenoids (and optional additional antioxidant) are present in an "effective amount" such that the rate of oxidation of the microbial biomass/oil (or any other compound that is subject to oxidation therein, e.g., ω-3 and/or ω-6 PUFAs) is reduced. One of skill in the art will understand that an effective amount of carotenoid antioxidant (and optional additional antioxidant) varies according to the product and/or product formulation according to target species and/or end use. Typically, the amount of antioxidant incorporated into the product takes into account losses associated with processing conditions, typical handling and storage conditions and the stability of the antioxidant in the product, to name a few.

In further preferred embodiments, the amount of PUFA present in the pigmented and/or stabilized microbial biomass/oil of the invention is an "effective" amount wherein the term "effective amount of PUFA" refers to the amount of a microbially produced ω-3/ω-6 PUFA incorporated into a product formulation that is sufficient to provide the desirable health characteristics associated with ω-3/ω-6 PUFA consumption. One of skill in the art can vary the amount and type of PUFA incorporated into the product formulation according to target species and/or end use. Typically, the amount of PUFA incorporated into the product takes into account losses associated with processing conditions, typical handling and storage conditions, the stability of the PUFA in the product, and the bioavailability/bioabsorption efficiency with the target species, to name a few.

In alternate embodiments, the invention provides an animal feed, food product, dietary supplement, pharmaceutical composition, infant formula, or personal care product comprising oleaginous yeast biomass/oil comprising at least one carotenoid (and optionally at least one ω-3/ω-6 PUFA and/or at least one additional antioxidant [e.g., $CoQ_6$, $CoQ_7$, $CoQ_8$, $CoQ_9$, $CoQ_{10}$, resveratrol]). In other words, the carotenoid product of the present invention is used as an ingredient in the final formulation of an animal feed, food product, dietary supplement, pharmaceutical composition, infant formula, or personal care product. It is contemplated that the pigmented and/or stabilized microbial biomass/oils of the invention comprising carotenoids will function in each of these applications to impart the health benefits of current formulations using more traditional sources of carotenoids. In preferred embodiments, yeast biomass comprises at least about 25 wt % oil, preferably at least about 30-40 wt %, and most preferably at least about 40-50 wt % microbially-produced oil.

Food Products and Infant Formulas

Pigmented and/or stabilized microbial biomass/oils of the invention comprising at least one carotenoid will be suitable for use in a variety of food and feed products including, but not limited to food analogs, meat products, cereal products, baked foods, snack foods and dairy products. Alternatively, the pigmented and/or stabilized biomass/oils (or derivatives thereof) may be incorporated into cooking oils, fats or margarines formulated so that in normal use the recipient would receive the desired amount for dietary supplementation. The pigmented biomass/oils may also be incorporated into infant formulas, nutritional supplements or other food products and may find use as anti-inflammatory or cholesterol lowering agents.

The term "food product" refers to any food generally suitable for human consumption. Typical food products include but are not limited to meat products, cereal products, baked foods, snack foods, dairy products and the like.

Meat products encompass a broad variety of products. In the United States "meat" includes "red meats" produced from cattle, hogs and sheep. In addition to the red meats there are poultry items which include chickens, turkeys, geese, guineas and ducks and the fish and shellfish. There is a wide assortment of seasoned and processed meat products: fresh, cured and fried, and cured and cooked. Sausages and hot dogs are examples of processed meat products. Thus, the term "meat products" as used herein includes, but is not limited to, processed meat products.

A cereal food product is a food product derived from the processing of a cereal grain. A cereal grain includes any plant from the grass family that yields an edible grain (seed). The most popular grains are barley, corn, millet, oats, quinoa, rice, rye, sorghum, triticale, wheat and wild rice. Examples of a cereal food product include, but are not limited to: whole grain, crushed grain, grits, flour, bran, germ, breakfast cereals, extruded foods, pastas and the like.

A baked goods product comprises any of the cereal food products mentioned above and has been baked or processed in a manner comparable to baking, i.e., to dry or harden by subjecting to heat. Examples of a baked good product include, but are not limited to: bread, cakes, doughnuts, bars, pastas, bread crumbs, baked snacks, mini-biscuits, mini-crackers, mini-cookies and mini-pretzels. As was mentioned above, pigmented and/or stabilized microbial biomass/oils of the invention can be used as an ingredient.

A snack food product comprises any of the above or below described food products.

A fried food product comprises any of the above or below described food products that has been fried.

A beverage can be in a liquid or in a dry powdered form. For example, there can be mentioned non-carbonated drinks; fruit juices, fresh, frozen, canned or concentrate; flavored or plain milk drinks, etc. Adult and infant nutritional formulas are well known in the art and commercially available (e.g., Similac®, Ensure®, Jevity®, and Alimentum® from Ross Products Division, Abbott Laboratories).

A dairy product is a product derived from milk. A milk analog or nondairy product is derived from a source other than milk, for example, soymilk. These products include, but are not limited to: whole milk, skim milk, fermented milk products such as yogurt or sour milk, cream, butter, condensed milk, dehydrated milk, coffee whitener, coffee creamer, ice cream, cheese, etc.

Additional food products into which the pigmented and/or stabilized microbial biomass/oils could be included are, for example: chewing gums, confections and frostings, gelatins and puddings, hard and soft candies, jams and jellies, white granulated sugar, sugar substitutes, sweet sauces, toppings and syrups, and dry-blended powder mixes.

As used herein, a "food analog" is a food-like product manufactured to resemble its food counterpart, whether meat, cheese, milk or the like, and is intended to have the appearance, taste, and texture of its counterpart. Thus, as used herein, the term "food product" also encompasses food analogs.

Food analogs can be made using processes well known to those skilled in the art. There can be mentioned meat analogs, cheese analogs, milk analogs and the like. Meat analogs made from soybeans contain soy protein or tofu and other ingredients mixed together to simulate various kinds of meats. These meat alternatives are sold as frozen, canned or dried foods. Usually, they can be used the same way as the foods they replace. Examples of meat analogs include, but are not limited to: ham analogs, sausage analogs, bacon analogs, and the like.

Food analogs can be classified as imitation or substitutes depending on their functional and compositional characteristics. For example, an imitation cheese need only resemble the cheese it is designed to replace. However, a product can generally be called a substitute cheese only if it is nutritionally equivalent to the cheese it is replacing and meets the minimum compositional requirements for that cheese. Thus, substitute cheese will often have higher protein levels than imitation cheeses and be fortified with vitamins and minerals.

Infant formulas are liquids or reconstituted powders fed to infants and young children. "Infant formula" is defined herein as an enteral nutritional product which can be substituted for human breast milk in feeding infants and typically is composed of a desired percentage of fat mixed with desired percentages of carbohydrates and proteins in an aqueous solution (e.g., see U.S. Pat. No. 4,670,285). Based on the worldwide composition studies, as well as levels specified by expert groups, average human breast milk typically contains about 0.20% to 0.40% of total fatty acids (assuming about 50% of calories from fat); and, generally the ratio of DHA to ARA would range from about 1:1 to 1:2 (see, e.g., formulations of Enfamil LIPIL™ [Mead Johnson & Company] and Similac Advance™ [Ross Products Division, Abbott Laboratories]). Infant formulas have a special role to play in the diets of infants because they are often the only source of nutrients for infants; and, although breast-feeding is still the best nourishment for infants, infant formula is a close enough second that babies not only survive but thrive.

Health Food Products and Pharmaceuticals

A health food product is any food product that imparts a health benefit and includes functional foods, medical foods, medical nutritionals and dietary supplements. Pigmented and/or stabilized microbial biomass/oils of the invention may also be used in standard pharmaceutical compositions.

As used herein, the term "functional food" refers to those foods that encompass potentially healthful products including any modified food or ingredient that may provide a health benefit beyond the traditional nutrients it contains. Functional foods can include foods like cereals, breads and beverages that are fortified with vitamins, herbs and nutraceuticals. Functional foods contain a substance that provides health benefits beyond its nutritional value, wherein the substance either is naturally present in the food or is deliberately added. As used herein, the term "nutraceutical" refers to any substance that may be considered a food or part of a food and provides medical or health benefits, including the prevention and treatment of disease.

As used herein, the term "medical food" refers to a food which is formulated to be consumed or administered enterally under the supervision of a physician and which is intended for the specific dietary management of a disease or condition for which distinctive nutritional requirements, based on recognized scientific principles, are established by medical evaluation [see section 5(b) of the Orphan Drug Act (21 U.S.C. 360ee(b)(3))]. A food is a "medical food" only if: (i) It is a specially formulated and processed product (as opposed to a naturally occurring foodstuff used in its natural state) for the partial or exclusive feeding of a patient by means of oral intake or enteral feeding by tube; (ii) It is intended for the dietary management of a patient who, because of therapeutic or chronic medical needs, has limited or impaired capacity to ingest, digest, absorb, or metabolize ordinary foodstuffs or certain nutrients, or who has other special medically determined nutrient requirements, the dietary management of which cannot be achieved by the modification of the normal diet alone; (iii) It provides nutritional support specifically modified for the management of the unique nutrient needs that result from the specific disease or condition, as determined by medical evaluation; (iv) It is intended to be used under medical supervision; and, (v) It is intended only for a patient receiving active and ongoing medical supervision wherein the patient requires medical care on a recurring basis for, among other things, instructions on the use of the medical food. Thus, unlike dietary supplements or conventional foods, a medical food that is intended for the specific dietary management of a disease or condition for which distinctive nutritional requirements have been established, may bear scientifically valid claims relating to providing distinctive nutritional support for a specific disease or condition. Medical foods are distinguished from the broader category of foods for special dietary use (e.g., hypoallergenic foods) and from foods that make health claims (e.g., dietary supplements) by the requirement that medical foods be used under medical supervision.

As used herein, the term "medical nutritional" is a medical food as defined herein and typically refers to a fortified beverage that is specifically designed for special dietary needs. The medical nutritional generally comprises a dietary composition focused at a specific medical or dietary condition. Examples of commercial medical nutritionals include, but are not limited to Ensure® and Boost®.

As used herein, the term "dietary supplement" refers to a product that: (i) is intended to supplement the diet and thus is not represented for use as a conventional food or as a sole item of a meal or the diet; (ii) contains one or more dietary ingredients (including, e.g., vitamins, minerals, herbs or other botanicals, amino acids, enzymes and glandulars) or their constituents; (iii) is intended to be taken by mouth as a pill, capsule, tablet, or liquid; and, (iv) is labeled as being a dietary supplement.

As used herein, the term "pharmaceutical" means a compound or substance which if sold in the United States would be controlled by e.g., Section 505 of the Federal Food, Drug and Cosmetic Act.

Engineered carotenoid-producing strains of oleaginous yeast of the present invention or pigmented and/or stabilized microbial biomass/oils produced therefrom could readily be incorporated into the any of the above mentioned health food products, to thereby produce e.g., a functional or medical food. For example more concentrated formulations comprising carotenoids and ω-3/ω-6 PUFAs (e.g., ARA or EPA) include capsules, powders, tablets, softgels, gelcaps, liquid concentrates and emulsions which can be used as a dietary supplement in humans or animals other than humans. Similarly, compositions comprising carotenoids and optionally at least one ω-3/ω-6 PUFA and/or at least one additional antioxidant can be used as dietary substitutes, or supplements, particularly infant formulas, for patients undergoing intravenous feeding or for preventing or treating malnutrition. Optionally, the compositions may be used for pharmaceutical use (human or veterinary). In this case, the pigmented PUFAs are generally administered orally but can be administered by any route by which they may be successfully absorbed, e.g., parenterally (e.g., subcutaneously, intramuscularly or intravenously), rectally, vaginally or topically (e.g., as a skin ointment or lotion).

Animal Feed Products

Animal feeds are generically defined herein as products intended for use as feed or for mixing in feed for animals other than humans. More specifically, the term "animal feed" refers to feeds intended exclusively for consumption by animals, including domestic animals (e.g., pets, farm animals, home aquarium fish, etc.) or for animals raised for the production of food (e.g., poultry, eggs, fish, crustacea, etc.).

More specifically, although not limited therein, it is expected that the pigmented and/or stabilized microbial biomass/oils of the present invention can be used within pet food products, ruminant and poultry food products and aquacultural food products. Pet food products are those products intended to be fed to a pet (e.g., a dog, cat, bird, reptile, rodent); these products can include the cereal and health food products above, as well as meat and meat byproducts, soy protein products, grass and hay products (e.g., alfalfa, timothy, oat or brome grass, vegetables). Ruminant and poultry food products are those wherein the product is intended to be fed to e.g., turkeys, chickens, cattle and swine. As with the pet foods above, these products can include cereal and health food products, soy protein products, meat and meat byproducts, and grass and hay products as listed above. Aquacultural food products (or "aquafeeds") are those products intended to be used in aquafarming, which concerns the propagation, cultivation or farming of aquatic organisms and/or animals in fresh or marine waters. More specifically, the term "aquaculture" refers to the production and sale of farm raised aquatic plants and animals. Typical examples of animals produced through aquaculture include, but are not limited to: lobsters, shrimp, prawns, and fish (i.e., ornamental and/or food fish).

The pigmented and/or stabilized microbial biomass/oils of the present invention (comprising at least one carotenoid [and optionally PUFAs and/or additional antioxidants]) can be used as an ingredient in any of the animal feeds described above. In addition to providing necessary carotenoid pigments, the oleaginous yeast itself is a useful source of protein and other nutrients (e.g., vitamins, minerals, nucleic acids, complex carbohydrates, etc.) that can contribute to overall animal health and nutrition, as well as increase a formulation's palatability. Accordingly it is contemplated that the addition of yeast biomass comprising the recombinant production hosts of the invention will be an excellent additional source of feed nutrients in animal feed formulations, wherein the term "feed nutrient" means nutrients such as proteins, lipids, carbohydrates, vitamins, minerals and nucleic acids that may be derived from the yeast biomass comprising the recombinant production hosts of the invention.

More specifically, for example, *Yarrowia lipolytica* (ATCC #20362) has the following approximate chemical composition, as a percent relative to the dcw: 35% protein, 40% lipid, 10% carbohydrate, 5% nucleic acids, 5% ash and 5% moisture. Furthermore, within the carbohydrate fraction, β-glucans comprise approximately 45.6 mg/g, mannans comprise approximately 11.4 mg/g, and chitin comprises approximately 52.6 mg/g (while trehalose is a minor component [approximately 0.7 mg/g]).

A considerable body of literature has examined the immuno-modulating effects of yeast β-glucans, mannans and chitin in both traditional animal husbandry and within the aquacultural sector. The means by which β-glucans, the primary constituents of bacterial and fungal cell walls, stimulate non-specific immunity (i.e., "immunostimulant effects") to thereby improve health of aquaculture species, pets and farm animals and humans are best studied, although both chitin and mannans are similarly recognized as useful immunostimulants (see PCT Publication No. WO 2006/052870).

Based on the unique protein:lipid:carbohydrate composition of *Yarrowia lipolytica*, as well as the unique complex carbohydrate profile (comprising an approximate 1:4:4.6 ratio of mannan:β-glucans:chitin), it is contemplated that the genetically engineered yeast cells of the present invention (or portions thereof) would be useful additives to animal feed formulations (e.g., as whole [lyophilized] yeast cells, as purified cells walls, as purified yeast carbohydrates or within various other fractionated forms).

In some embodiments, wherein the pigmented and/or stabilized microbial biomass/oils of the present invention comprise an effective amount of at least one carotenoid (preferably lutein, lycopene, β-carotene, canthaxanthin, astaxanthin and/or zeaxanthin), the biomass/oil is suitable as an ingredient in a "pigmented feed product" or "pigmented animal feed". Many animals have been reported to acquire tissue pigmentation by absorbing xanthophylls in their feed. In one embodiment, the pigmented animal feed is an animal feed selected from the group consisting of: fish feed, crustacea feed, shrimp feed, crab feed, lobster feed, and chicken feed. The nutritional requirements and feed forms for each animal feed are well known in the art (for example, see *Nutrient Requirements of Fish*, published by the Board of Agriculture's Committee on Animal Nutrition, National Research Council, National Academy: Washington, D.C. 1993; and *Nutrient Requirements of Poultry*, published by the Board of Agriculture's Committee on Animal Nutrition, National Research Council, National Academy: Washington, D.C. 1994).

Various means are available to incorporate the pigmented and/or stabilized microbial biomass/oils of the present invention into animal feed (typically in the form of feed pellets). For example, the biomass/oils can be incorporated into the feed mash prior to extrusion or after the extrusion process ("post-extrusion applied") by mixing and dispersing the biomass/oils in a suitable oil that is subsequently applied to the pellet. Typically a "suitable oil" is fish oil (e.g., Capelin oil) or a vegetable oil (e.g., corn oil, sunflower oil, soybean oil, etc.), although in preferred embodiments of the present invention the "suitable oil" is microbially produced. In preferred embodiments of the present invention, an effective amount of recombinantly produced carotenoid is supplied within an effective amount of microbial oil produced from recombinant. *Yarrowia lipolytica*, wherein the carotenoid and oil are co-produced. In alternate embodiments, however, microbially produced oil may be admixed with the pigmented or stabilized microbial biomass/oils of the present invention or purified carotenoids of the present invention to result in the appropriate concentration of each.

Although the amount of total carotenoid incorporated into the post-extrusion prepared pigmented animal feed may be less than that found in pre-extrusion supplemented feed, the resulting preferential isomer content may be higher (e.g., the heat of the extrusion process may isomerize some pigments). It should be noted that many extrusion processes run at elevated temperatures sufficient to possibly degrade and/or alter carotenoids supplemented to the feed mash prior to extrusion. It is possible to use a cold extrusion process to circumvent this problem; however, the physical stability of the cold-extruded pellets tends to be inferior in comparison to the "hot-extruded" feed pellets.

The size and shape of the feed pellets may vary according to the target species and developmental stage. The amount of pigmented biomass product formulated into feed pellets can be adjusted and/or optimized for the particular application. Factors to consider include, but are not limited to: the concentration of the pigment in the biomass, the concentration of the pigment in the pigmentation product, the target species, the age and/or growth rate of the selected species, the type of carotenoid used, the bioabsorption characteristics of the chosen pigment in the context of the species to be pigmented, the feeding schedule, the cost of the pigment, and the palatability of the resulting feed. One of skill in the art can adjust the amount of pigmented and/or stabilized microbial biomass/oil incorporated into the feed so that adequate levels of carotenoid are present while balancing the nutritional requirements of the species. Typical concentrations of the carotenoid pigment incorporated into, for example, fish feed range from about 10 to about 200 mg/kg of fish feed, wherein a preferred range is from about 10 mg/kg to about 100 mg/kg, a more preferred range is from about 10 mg/kg to about 80 mg/kg and a most preferred range is from about 20 mg/kg to about 60 mg/kg, depending on the specific product.

Although numerous commercial products comprising the pigmented and/or stabilized microbial biomass/oils of the invention (or isolated carotenoids thereof) are contemplated by the Applicants herein, applications of the products of the invention are described below in additional detail in reference to various specific animal feeds. Generally, the recombinant oleaginous yeast biomass comprises about 0.1 wt % to about 50 wt % of the animal feed, preferably about 0.5 wt % to about 20 wt %, more preferably about 1 wt % to about 10 wt %, most preferably about 1 wt % to about 5 wt %. These examples are not intended to be limiting to the invention herein.

Chicken Feed—Nutritional Requirements:

The dietary requirements of poultry are well known (see Nutrient Requirements of Poultry, published by the Board of Agriculture's Committee on Animal Nutrition, National Research Council, National Academy: Washington, D.C. 1994). Typical feeds are comprised of crude protein (including essentially amino acids), carbohydrates, fats/lipids (e.g., ω-3/ω-6 PUFAs), vitamins (i.e., fat and water soluble), minerals (i.e., both macrominerals and trace minerals) and water. Additional feed ingredients may include antioxidants (e.g., $CoQ_9$, $CoQ_{10}$, resveratrol; typically included to prevent oxidation of lipids and/or pigments), hormones, antibiotics and pigments (i.e., carotenoids), to name of few. The source of the various components is typically chosen based on cost, availability and quality of the nutrients they contain. Typically, components include, but are not limited to: cereal grains (primarily carbohydrates and protein), animal protein meal, animal or vegetable fats/lipids, and isolates from various plants including corn, rice, alfalfa and soybean, to name a few.

When producing a "poultry pigmentation product", referring to pigmented feed additives used to color poultry via commercial farming techniques, preferred carotenoids are lutein, canthaxanthin, astaxanthin and/or zeaxanthin. Typically, the poultry is a chicken and the pigmentation product is used to pigment chicken tissue (e.g., skin) and/or egg yolks.

Crustacea Feed—Nutritional Requirements:

The dietary requirements of crustacea are well-known (see "Training Manual on Shrimp and Fish Nutrition and Feed Management", CIBA Special Bulletin No. 15; Oct. 22-31, 2002; Ali, Amanad, ed.; published by the Central Institute of Brackishwater Aquaculture (CIBA), Chemai, India, hereinafter referred to as "Amanad"). Typical feeds are comprised of crude protein (including essentially amino acids), carbohydrates, fats/lipids (e.g., ω-3/ω-6 PUFAs), vitamins (i.e., fat and water soluble), minerals (i.e., both macrominerals and trace minerals) and water. Additional feed ingredients may include antioxidants (e.g., $CoQ_9$, $CoQ_{10}$, resveratrol; typically included to prevent oxidation of lipids and/or pigments), hormones, antibiotics and pigments (i.e., carotenoids), to name of few. The source of the various components is typically chosen based on cost, availability and quality of the nutrients they contain. Typically, components include, but are not limited to: cereal grains (primarily carbohydrates and protein), animal protein meal (e.g., fish, prawn, squid, and clam meat meal), animal or vegetable fats/lipids, and isolates from various plants including corn, rice, alfalfa, soybean, groundnut cake (i.e., peanuts), sunflower cake, and gingelly (sesame) cake, to name a few. Examples of the moisture, protein, fat, fiber, carbohydrate, and ash content of various raw feed materials typically used in feed is shown in Tables 5 and 6 (see Amanad).

TABLE 5

Composition Of Various Raw Feed Materials Used In Preparing Shrimp Feed

| Ingredient | Moisture | Protein | Fat | Fiber | Carbohydrate | Ash |
|---|---|---|---|---|---|---|
| Fish Meal | 10.8 | 55.0 | 5.4 | 1.73 | 3.27 | 23.78 |
| Prawn Head | 9.91 | 39.8 | 9.6 | 16.3 | 4.0 | 20.18 |
| Squid Meal | 8.4 | 66.5 | 4.4 | 3.98 | 5.9 | 10.8 |
| Clam meat meal | 10.1 | 49.9 | 8.66 | — | 28.3 | 7.75 |
| Soybean Meal | 10.45 | 51.5 | 1.00 | 8.85 | 19.7 | 8.5 |
| Groundnut Cake | 13.05 | 46.93 | 5.0 | 8.9 | 18.03 | 8.9 |
| Sunflower Cake | 7.0 | 26.69 | 2.04 | 30.13 | 26.37 | 7.7 |
| Gingelly Cake | 9.76 | 38.71 | 6.00 | 10.96 | 15.8 | 19.02 |

*Note:
All values reported as weight percent (wt %) of ingredient.

TABLE 6

Typical Composition Of Feed Formulation For Shrimp

| Ingredient | Starter Feed | Grower Feed | Finishing Feed |
|---|---|---|---|
| Crude protein | 40-45 | 38-40 | 35-38 |
| Lipid | 6-8 | 8-10 | 8-10 |
| Carbohydrate | 10-16 | 15-20 | 20-25 |
| Crude fiber | 1-2 | 1-3 | 2-4 |
| Ash | 10-12 | 10-15 | 12-18 |
| Mineral mix | 2-5 | 2-5 | 2-5 |

* Note:
All values reported as weight percent (wt %) of ingredient.

Mixtures comprising these compositions are blended and then pelleted and dried with 16-17% moisture.

When producing a "crustacean pigmentation product", referring to pigmented feed additives used to color crustaceans via commercial aquacultural techniques, preferred carotenoids are canthaxanthin and/or astaxanthin. Typically, the crustaceans are shrimp or lobsters and the pigmentation product is used to pigment tissue and shells.

Fish Feed—Xanthophylls Supplementation:

Many commercially important fish have pigmented pink muscle tissue. Fish cannot synthesize xanthophylls; therefore, they must obtain them from there diet. Wild fish obtain the necessary carotenoids responsible for flesh pigmentation from their natural diet (i.e., from zooplankton that naturally produce xanthophylls). However, farm raised fish (i.e., aquaculture) need to obtain the pigments by supplementing standard fish feed formulations with one or more pigments. It is important to include pigment in the diet of farm-raised fish as consumers generally prefer pigmented muscle tissue, especially when purchasing salmonid fish products (e.g., pink salmon fillets).

Many fish preferentially bioabsorb certain isomers of the present carotenoids (i.e., 3S,3'S-astaxanthin or all-E-canthaxanthin). Enzymatic synthesis typically produces more of the desired isomer when compared to chemically synthesized xanthophylls. In one aspect, the amount of preferentially bioabsorbed isomer is at least about 40% of the total xanthophyll content, preferably at least about 50% of the total xanthophyll content, even more preferable at least about 70%, and most preferably at least about 85% of the total amount of the respective xanthophyll in the resulting pigmented feed material.

Astaxanthin is the major carotenoid of wild salmonid fishes (Khare et al., *Comp. Biochem. Physiol.*, 45B:971-973 (1973); Schiedt et al., *Helv. Chim. Acta.*, 64:449-457 (1981), Schiedt et al., *Comp. Biochem. Physiol.*, 83B:9-12 (1986)). In farmed Atlantic salmon, the characteristic flesh colour is caused by carotenoids, usually astaxanthin or canthaxanthin, which are supplemented to the diet (reviewed by Torrissen et al., *CRC Crit. Rev. Aquat. Sci.*, 1:209-225 (1989); Storebakken, T. and No, H., *Aquaculture*, 100:209-229 (1992)). Whereas astaxanthin is more efficiently accumulated in the muscle of rainbow trout than canthaxanthin (reviewed by Storebakken, T. and No, H., supra, 1992), the opposite appears to be true for Atlantic salmon (Buttle et al., *L. Aquacult. Res.*, 32:103-111 (2001); Baker et al., *Anim. Feed. Sci. Technol.*, 99:97-106 (2002)).

Canthaxanthin consists of 272 possible geometrical E/Z isomers of which the quantitatively most important are all-E-, 9Z-, 13Z-, and 15Z-astaxanthin. With respect to astaxanthin, the all-E-astaxanthin isomer is more efficiently utilized for pigmentation of rainbow trout muscle than the Z-isomers (Bjerkeng et al., *Aquaculture*, 157:63-82 (1997); Østerlie et al., *J. Nutr.*, 129:391-398 (1999)).

The efficiency of dietary canthaxanthin or astaxanthin utilisation for flesh pigmentation in Atlantic salmon and rainbow trout rarely exceeds 10-15% (Torrissen et al., supra, 1989; Storebakken, T. and No, H., supra, 1992). This has been explained in general terms by poor uptake from the intestinal tract (faecal losses normally account for ⅔ of the dietary astaxanthin) and by poor retention (less than ½) of the absorbed astaxanthin. Carotenoids are poorly absorbed in young salmon (Schiedt et al., *Pure Appl. Chem.*, 57:685-692 (1985)). Astaxanthin deposition has been shown to vary in different life stages of rainbow trout, and in the muscle a theoretical saturation level of 100 mg/kg has been estimated (Bjerkeng et al., *Aquaculture*, 108:333-346 (1992)). This is far from the levels (up to 15 mg/kg) experienced in commercial farming of Atlantic salmon.

Fish Feed—Nutritional Requirements:

An increased understanding of the nutritional requirements for various fish species and technological advances in feed manufacturing have allowed the development and use of manufactured or artificial diets (formulated feeds) to supplement or to replace natural feeds in the aquaculture industry. The dietary requirements of fish are well known (see Nutrient Requirements of Fish, published by the Board of Agriculture's Committee on Animal Nutrition, National Research Council, National Academy: Washington, D.C. 1993). The dietary requirements of fish feed may vary according to species, aquatic environment, temperature and age. However, the general nutrition requirements for most aquatic species produced via aquaculture are known and are generally comprised of about 25 wt % to about 55 wt % crude protein (including essentially amino acids), up to about 30 wt % lipids (e.g., ω-3/ω-6 PUFAs), vitamins (i.e., fat and water soluble), minerals (i.e., including essential minerals), carbohydrates (sometimes included as an economical energy source although not required) and water (typically about 6-40 wt % depending upon the desired product form). Additional feed ingredients may include: (1) antioxidants (i.e., $CoQ_9$, $CoQ_{10}$, resveratrol), to prevent oxidation of lipids and/or pigments and to extend product shelf-life; (2) carotenoids, particularly for salmonid and ornamental "aquarium" fishes, to enhance tissue coloration of e.g., muscle, skin, shell, etc.; (3) binding agents, to provide stability to the pellet and reduce leaching of nutrients into the water (e.g., beef heart, starch, cellulose, pectin, gelatin, gum arabic, locust bean, agar, carageenin and other alginates); (4) chemoattractants and flavorings, to enhance feed palatability and its intake; and, (5) other feedstuffs. These other feedstuffs can include such materials as hormones, antibiotics, fiber and ash (for use as a filler and as a source of calcium and phosphorus, respectively), vegetable matter and/or fish or squid meal (e.g., live, frozen or dried algae, brine shrimp, rotifers or other zooplankton) to enhance the nutritional value of the diet and increase its acceptance by the fish.

When producing a "fish pigmentation product", referring to pigmented feed additives used to color fish via commercial aquacultural techniques, preferred carotenoids are canthaxanthin and/or astaxanthin. Fish pigmented by absorbing carotenoids include, but are not limited to salmonids, carp (*Cyprinus* sp.), red sea bream, tilapia, goldfish, Cichlidae, and yellowtail (*Serola lalandi*). In one aspect, fish pigmented using the present materials are members of the family Salmonidae, whose typical members include salmon, trout and chars.

The source of the various components is typically chosen based on cost relative to growth performance. Typically, components include but are not limited to: fish meal, fish oil (typically marine fish oil), meat meal, shrimp meal, and isolates from various plants including corn, rice, and soybean, to name a few. In one aspect, the majority of the crude protein and crude lipids in the fish feed is preferably provided by fish meal and fish oil. In more preferred embodiments, the fish oil is replaced with microbially produced oil, preferably extracted from an oleaginous yeast.

The manufacture of aquafeed formulations requires consideration of a variety of factors, since a complete diet must be nutritionally balanced, palatable, water stable and have the proper size and texture. With regard to nutrient composition of aquafeeds, one is referred to: *Handbook on Ingredients for Aquaculture Feeds* (Hertrampf, J. W. and F. Piedad-Pascual. Kluwer Academic: Dordrecht, The Netherlands, 2000) and *Standard Methods for the Nutrition and Feeding of Farmed Fish and Shrimp* (Tacon, A. G. J. Argent Laboratories: Redmond, 1990). In general, feeds are formulated to be dry (i.e., final moisture content of 6-10%), semi-moist (i.e., 35-40% water content) or wet (i.e., 50-70% water content). Dry feeds include the following: simple loose mixtures of dry ingredients (i.e., "mash" or "meals"); compressed pellets, crumbles or granules; and flakes. Depending on the feeding requirements of the fish, pellets can be made to sink or float. Semi-moist and wet feeds are made from single or mixed ingredients (e.g., trash fish or cooked legumes) and can be shaped into cakes or balls.

Based on the above discussions relating to the nutritional requirements for chicken feeds, crustacean feeds and fish feeds, it will be clear that the present invention also includes a method of pigmenting an animal, wherein a pigmented animal feed is provided (comprising an effective amount of pigmented microbial biomass/oils of the present invention comprising at least one caretenoid) and said animal is fed said pigmented animal feed, thereby resulting in pigmentation of at least one tissue in said animal or an animal product produced thereof. Similarly, in yet another aspect, the invention provides an animal tissue (or animal product produced thereof) pigmented by feeding an animal an animal feed comprising a carotenoid produced by the present process.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions.

General Methods

Standard recombinant DNA and molecular cloning techniques used in the Examples are well known in the art and are described by:

1.) Sambrook, J., Fritsch, E. F. and Maniatis, T. *Molecular Cloning: A Laboratory Manual*; Cold Spring Harbor Laboratory: Cold Spring Harbor, N.Y. (1989) (Maniatis); 2.) T. J. Silhavy, M. L. Bennan, and L. W. Enquist, Experiments with Gene Fusions; Cold Spring Harbor Laboratory: Cold Spring Harbor, N.Y. (1984); and, 3.) Ausubel, F. M. et al., Current Protocols in Molecular Biology, published by Greene Publishing Assoc. and Wiley-Interscience, Hoboken, N.J. (1987).

Materials and methods suitable for the maintenance and growth of microbial cultures are well known in the art. Techniques suitable for use in the following examples may be found as set out in Manual of Methods for General Bacteriology (Phillipp Gerhardt, R. G. E. Murray, Ralph N. Costilow, Eugene W. Nester, Willis A. Wood, Noel R. Krieg and G. Briggs Phillips, Eds), American Society for Microbiology: Washington, D.C. (1994)); or by Thomas D. Brock in Biotechnology: A Textbook of Industrial Microbiology, 2nd ed., Sinauer Associates: Sunderland, Mass. (1989). All reagents, restriction enzymes and materials used for the growth and maintenance of microbial cells were obtained from Aldrich Chemicals (Milwaukee, Wis.), DIFCO Laboratories (Detroit, Mich.), New England Biolabs, Inc. (Beverly, Mass.), GIBCO/BRL (Gaithersburg, Md.), or Sigma Chemical Company (St. Louis, Mo.), unless otherwise specified. *E. coli* strains were typically grown at 37° C. on Luria Bertani (LB) plates.

General molecular cloning was performed according to standard methods (Sambrook et al., supra). Oligonucleotides were synthesized by Sigma-Genosys (Spring, Tex.). Individual PCR amplification reactions were carried out in a 50 µl total volume, comprising: PCR buffer (containing 10 mM KCl, 10 mM $(NH_4)_2SO_4$, 20 mM Tris-HCl (pH 8.75), 2 mM $MgSO_4$, 0.1% Triton X-100), 100 µg/mL BSA (final concentration), 200 µM each deoxyribonucleotide triphosphate, 10 pmole of each primer and 1 µl of Pfu DNA polymerase (Stratagene, San Diego, Calif.), unless otherwise specified. Alternatively, PCR amplification reactions were carried out in a 50 µl total volume, comprising: 19.75 µL sterile $dH_2O$, 5 µL MasterAmp™ Taq 10×PCR Buffer, 4 µL $MgCl_2$ (25 mM), 15 µL MasterAmp™ 10×PCR Enhancer, 1 µL each (10 mM) of dATP, dCTP, dGTP and dTTP, 1 each of Forward and Reverse primers, 0.25 µL MasterAmp™ Taq DNA polymerase (Epicentre® Biotechnologies, Madison, Wis.), unless otherwise specified.

The meaning of abbreviations is as follows: "sec" means second(s), "min" means minute(s), "h" means hour(s), "d" means day(s), "µL" means microliter(s), "mL" means milliliter(s), "L" means liter(s), "µM" means micromolar, "mM" means millimolar, "M" means molar, "mmol" means millimole(s), "µmol" mean micromole(s), "g" means gram(s), "µg" means microgram(s), "ng" means nanogram(s), "U" means unit(s), "bp" means base pair(s), "dcw" means dry cell weight, and "kB" means kilobase(s).

The structure of an expression cassette will be represented by a simple notation system of "X::Y::Z", wherein X describes the promoter fragment, Y describes the gene fragment, and Z describes the terminator fragment, which are all operably linked to one another.

Cultivation of *Yarrowia lipolytica*

*Yarrowia lipolytica* strain ATCC #20362 was purchased from the American Type Culture Collection (Rockville, Md.). *Yarrowia lipolytica* strains were routinely grown at 28-30° C. in several media, according to the recipes shown below. Agar plates were prepared as required by addition of 15-20 g/L agar to each liquid media, according to standard methodology.

YPD agar medium (per liter): 10 g of yeast extract [Difco], 20 g of Bacto peptone [Difco]; and 20 g of glucose.

Basic Minimal Media (MM) (per liter): 20 g glucose; 1.7 g yeast nitrogen base without amino acids; 1.0 g proline; and pH 6.1 (not adjusted).

Minimal Media+Uracil (MM+uracil or MMU) (per liter): Prepare MM media as above and add 0.1 g uracil and 0.1 g uridine.

Minimal Media+Uracil+Sulfonylurea (MMU+SU) (per liter): Prepare MMU media as above and add 280 mg sulfonylurea.

Minimal Media+Leucine (MM+leucine or MMLeu) (per liter): Prepare MM media as above and add 0.1 g leucine.

Minimal Media+Leucine+Uracil (MMLeuUra) (per liter): Prepare MMU media as above and add 0.1 g leucine.

Minimal Media+Lysine (MM+Lysine or MMLys) (per liter): Prepare MM media as above and add 0.1 g lysine.

Minimal Media+Leucine+Lysine (MMLeuLys) (per liter): Prepare MMLeu media as above and add 0.1 g lysine.

Minimal Media+Leucine+Lysine+Uracil (MMLeuLysUra) (per liter): Prepare MMLeuLys media as above and add 0.1 g uracil and 0.1 g uridine.

Minimal Media+5-Fluoroorotic Acid (MM+5-FOA) (per liter): 20 g glucose, 6.7 g Yeast Nitrogen base without amino acids, 75 mg uracil, 75 mg uridine and appropriate amount of FOA (Zymo Research Corp., Orange, Calif.), based on FOA activity testing against a range of concentrations from 100 mg/L to 1000 mg/L (since variation occurs within each batch received from the supplier).

High Glucose Media (HGM) (per liter): 80 glucose, 2.58 g $KH_2PO_4$ and 5.36 g $K_2HPO_4$, pH 7.5 (do not need to adjust).

Fermentation medium* without Yeast Extract (FM* without YE) (per liter): 6.70 g/L Yeast nitrogen base (YNB, without amino acids and without ammonium sulfate); 6.00 g $KH_2PO_4$; 2.00 g $K_2HPO_4$; 1.50 g $MgSO_4*7H_2O$; 1.5 mg thiamine hydrochloride; and 20 g glucose.

Fermentation medium* (FM*) (per liter): Prepare FM* without YE media as above and add 5.00 g Yeast extract (BBL).

The methodology used to create various Ura− strains of *Yarrowia lipolytica* (a "recycling" protocol that resulted in removal of the Ura marker) relied on site-specific recombinase systems. Briefly, the site-specific recombination system consists of two elements: (1) a recombination site having a characteristic DNA sequence [e.g., LoxP]; and, (2) a recombinase enzyme that binds to the DNA sequence specifically and catalyzes recombination (i.e., excision) between DNA sequences when two or more of the recombination sites are oriented in the same direction at a given interval on the same DNA molecule [e.g., Cre]. For the purposes herein, an integration construct was created comprising a target gene that was desirable to insert into the host genome (i.e., a first selection marker [i.e., Ura3]) that was flanked by recombination sites. Following transformation and selection of the transformants, the first selection marker was excised from the chromosome by the introduction of a replicating plasmid carrying a second selection marker (i.e., Leu2 or sulfonylurea resistance [AHAS]) and a recombinase suitable to recognize the site-specific recombination sites introduced into the genome (i.e., Cre). Upon selection of those transformants carrying the second marker, the replicating plasmid was then cured from the host in the absence of selection and excision of the first selection marker from the cured strain's host genome was confirmed by loss of Ura prototrophy. This produced a transformant that possessed neither the first nor second selection marker, and thus the cured strain was available for another round of transformation using the first selection marker. Additional details concerning site-specific recombinase based methodology for use in *Yarrowia lipolytica* is described in PCT Publication No. WO 2006/052870.

The second selection marker gene occasionally utilized in *Yarrowia lipolytica* is a native *Y. lipolytica* acetohydroxyacid synthase (AHAS or acetolactate synthase; E.G. 4.1.3.18; GenBank Accession No. XM_501277) containing a single amino acid change (W497L) that confers sulfonyl urea herbicide resistance ($SU^R$; described in PCT Publication No. WO 2006/052870) (SEQ ID NO:1). AHAS is the first common enzyme in the pathway for the biosynthesis of branched-chain amino acids and it is the target of the sulfonylurea and imidazolinone herbicides.

Fatty Acid Analysis of *Yarrowia lipolytica*

For fatty acid analysis, cells were collected by centrifugation and lipids were extracted as described in Bligh, E. G. and Dyer, W. J. (*Can. J. Biochem. Physiol.*, 37:911-917 (1959)). Fatty acid methyl esters were prepared by transesterification of the lipid extract with sodium methoxide (Roughan, G., and Nishida I., *Arch. Biochem. Biophys.*, 276 (1):38-46 (1990)) and subsequently analyzed with a Hewlett-Packard 6890 GC fitted with a 30-m×0.25 mm (i.d.) HP-INNOWAX (Hewlett-Packard) column. The oven temperature was from 170° C. (25 min hold) to 185° C. at 3.5° C./min.

For direct base transesterification, *Yarrowia* culture (3 mL) was harvested, washed once in distilled water, and dried under vacuum in a Speed-Vac for 5-10 min. Sodium methoxide (100 µl of 1%) was added to the sample, and then the sample was vortexed and rocked for 20 min. After adding 3 drops of 1 M NaCl and 400 µl hexane, the sample was vortexed and spun. The upper layer was removed and analyzed by GC as described above.

Example 1

DNA Transformation in *Yarrowia lipolytica*

The following general procedure was used to make *Yarrowia lipolytica* chemically competent for DNA transformation (Chen, D. C. et al., *Appl. Microbiol. Biotechnol.*, 48:232-235 (1997)).

*Yarrowia* cells were streaked on YPD medium plates 1 day prior to transformation. The cells were incubated at 30° C. Several large loopfuls (~3) of cells from the YPD plate were resuspended in 1 mL of transformation medium [comprising 2.25 mL 50% PEG (average MW 3350); 0.125 mL 2 M lithium acetate pH 6.0; 0.125 mL 2 M dithiothreitol (DTT; prepared fresh prior to each use); and optionally 50 µL salmon sperm DNA (10 mg/mL)]. Approximately 100 µL of the *Yarrowia* cells suspended in the transformation medium were mixed with 100 to 500 ng of the desired plasmid (in linearized form when transforming integration plasmids). The cells were subsequently incubated at 39° C. for 1 hr and mixed using a Vortex mixer about every 15 min. After incubation, the cells were streaked on MM agar plates with appropriate selection and incubated at 30° C. for a defined period of time (typically up to 4 days) depending upon the specific plasmid. Alternatively, transformants were selected on MM+5-FOA agar plates. Transformants containing self-replicating plasmid were visible within about 2-6 days depending upon the strain. Transformants containing an integrative plasmid were typically visible within 3-4 days.

Example 2

Construction of *Yarrowia lipolytica* Strain YL5, Producing Lycopene

The present Example describes the construction of lycopene-producing *Yarrowia lipolytica* strain YL5. This strain was prepared as a means to initially demonstrate the feasibility of $C_{40}$ carotenoid biosynthesis in an oleaginous yeast.

After construction of integration vector pYCRTEBI (comprising crtE, crtB and crtI genes for lycopene synthesis) and transformation of the vector into *Yarrowia lipolytica* Y2224 (i.e., a Ura⁻ derivative of *Y. lipolytica* ATCC#20362 [isolation described in Example 7]), lycopene production was characterized in resulting strain YL5 under growth and oleaginous conditions.

Construction of Integration Vector for Lycopene Biosynthesis

Production of lycopene requires crtE, crtB and crtI genes, which encode GGPP synthase (CrtE), phytoene synthase (CrtB) and phytoene desaturase (CrtI), respectively. The crtE, crtB and crtI genes from *Pantoea stewartii* DC413 (U.S. Pat. No. 7,288,387) were selected (Table 7). In order to optimize the expression of these 3 genes, they were codon-optimized based on the codon usage preference for *Yarrowia lipolytica* (U.S. Pat. No. 7,125,672). The synthetic genes were produced by GenScript Corp. (Piscataway, N.J.) and provided in the high-copy vector pUC57 (GenBank® Accession No. Y14837).

TABLE 7

Codon-Optimized Carotenoid Biosynthesis Genes Derived From *Pantoea stewartii* DC413

| Carotenoid Gene | Codon Optimized Nucleotide Sequence (SEQ ID NO) | Amino Acid Sequence (SEQ ID NO) |
|---|---|---|
| crtE$_{syn}$ | 2 | 3 |
| crtB$_{syn}$ | 4 | 5 |
| crtI$_{syn}$ | 6 | 7 |

During synthesis of these genes, a NcoI restriction site was introduced at the ATG start site and a NotI site was introduced after the translational stop codon. These two sites were used to facilitate the assembly of the genes with different promoters and terminators.

Figure 5:
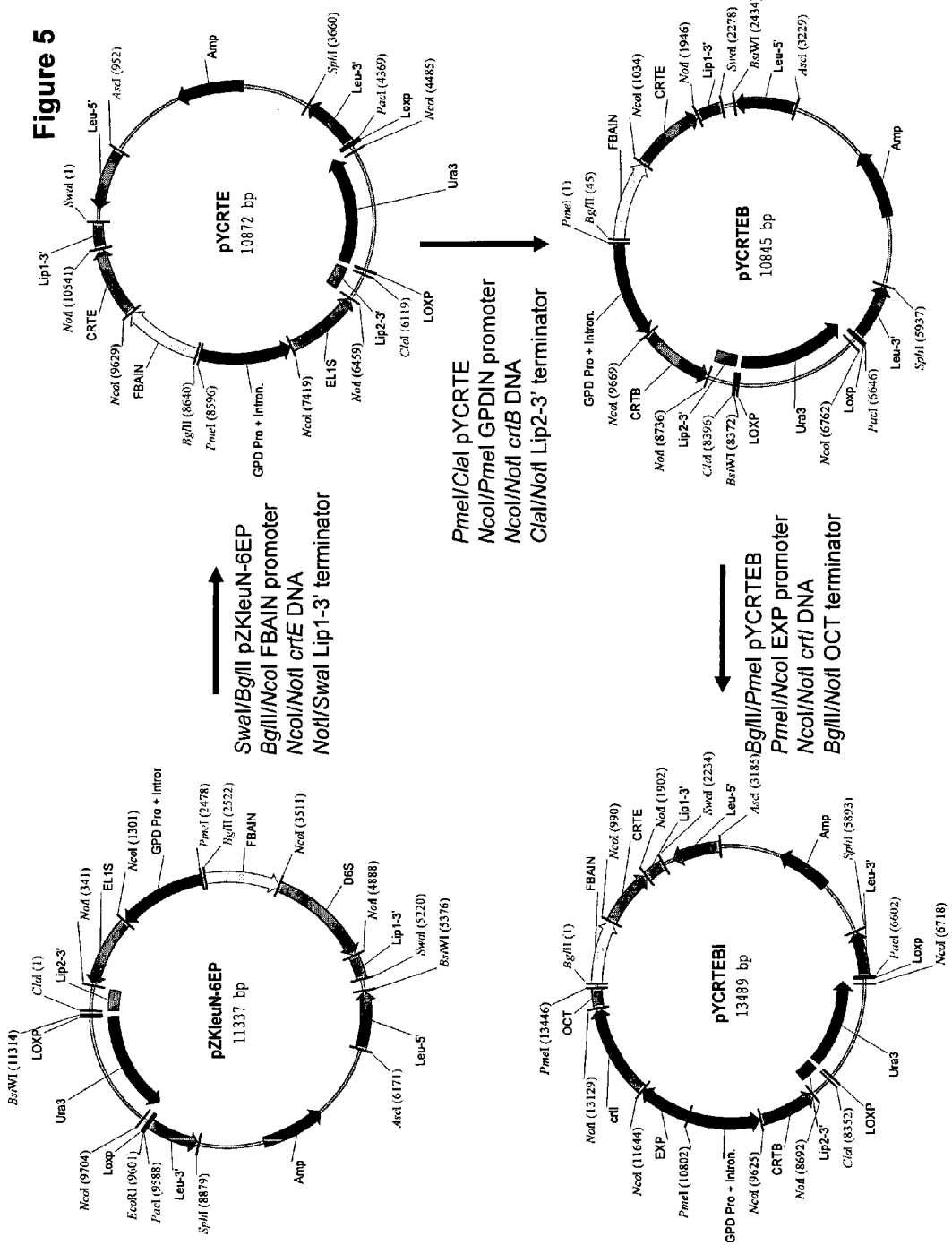
FIG. 5 illustrates the construction of plasmid pYCRTEBI.

The construction of vector pYCRTEBI, comprising the codon-optimized crtE$_{syn}$, crtB$_{syn}$ and crtI$_{syn}$ genes, is summarized in FIG. 5. Integration vector pZKLeuN-6EP (SEQ ID NO:8) was used as the vector backbone.

TABLE 8

Components Of Plasmid pZKLeuN-6EP (SEQ ID NO: 8)

| RE Sites And Nucleotides Within SEQ ID NO: 8 | Description Of Fragment And Chimeric Gene Components |
|---|---|
| BsiWI/EcoRI (11314-9601) | LoxP::Ura3::LoxP, comprising: LoxP sequence (SEQ ID NO: 9); *Yarrowia* Ura3 gene (GenBank Accession No. AJ306421); LoxP sequence (SEQ ID NO: 9) |

TABLE 8-continued

Components Of Plasmid pZKLeuN-6EP (SEQ ID NO: 8)

| RE Sites And Nucleotides Within SEQ ID NO: 8 | Description Of Fragment And Chimeric Gene Components |
|---|---|
| BglII/SwaI (2522-5220) [wherein bp 3511-4888, corresponding to D6S, can be excised by a NcoI/NotI digestion] | FBAIN::D6S::Lip1, comprising: FBAIN: *Yarrowia lipolytica* FBAIN promoter (PCT Publication No. WO 2005/049805; U.S. Pat. No. 7,202,356); D6S: codon-optimized Δ6 desaturase gene (PCT Publication No. WO 2004/101753; U.S. Pat. No. 7,125,672), derived from *Mortierella alpina* (GenBank ® Accession No. AF465281); Lip1: Lip1 terminator sequence from *Yarrowia* Lip1 gene (GenBank ® Accession No. Z50020) |
| PmeI/ClaI (2478-1) [wherein bp 1301-341, corresponding to EL1S, can be excised by a NcoI/NotI digestion] | GPDIN::EL1S::Lip2, comprising: GPDIN: *Yarrowia lipolytica* GPDIN promoter (Patent Publication US 2006/0019297-A1; labeled as "GPD Pro +Intron" in FIG.); EL1S: codon-optimized elongase 1 gene (PCT Publication No. WO 2004/101753; U.S. Pat. No. 7,125,672), derived from *Mortierella alpina* (GenBank ® Accession No. AX464731); Lip2: Lip2 terminator sequence from *Yarrowia* Lip2 gene (GenBank ® Accession No. AJ012632) |
| AscI/BsiWI (6171-5376) | 5' region of *Yarrowia* Leu2 gene (GenBank ® Accession No. AF260230) |
| PacI/SphI (9588-8879) | 3' region of *Yarrowia* Leu2 gene (GenBank ® Accession No. AF260230) |

Vector pZKleuN-6EP contains DNA regions from the *Yarrowia* Leu2 gene that are involved in leucine biosynthesis. Integration of the DNA fragments in this region will result in a phenotype that requires the presence of the amino acid leucine in the minimal medium for growth. In addition, the plasmid contains a Ura3 gene as a selection marker for growth requirement with uracil. The plasmid also has different promoter-terminator modules.

In the first step of the construction of vector pYCRTEBI, the crtE$_{syn}$ gene (SEQ ID NO:2) was digested with NcoI and NotI. The promoter region, FBAIN was isolated from pZKleuN-6EP as a BglII/NcoI fragment; similarly, the terminator Lip1 was isolated as a NotI/SwaI fragment. The integration vector was digested with enzymes BglII and SwaI. All DNA fragments were gel purified and then recovered using a BIO101® Geneclean® II kit (QBiogene, Irvine, Calif.) or Zymoclean™ Gel DNA recovery kit (Zymo Research Corp., Orange, Calif.). A four-way ligation procedure was used to assemble these fragments. The ligation reaction had a final volume of 11 µL that contained 5.25 µL of 2× rapid ligation buffer (Promega, Madison, Wis.), 0.75 µL of vector, 1.33 µL of each insert, and 1 µL of enzyme (T4 DNA ligase, Promega). The reaction was allowed to proceed for 2 hr at room temperature. After ligation, 2 µL of the mixture was transformed into *E. coli* XL2-Blue ultracompetent cells (Stratagene, La Jolla, Calif.).

The resulting vector, pYCRTE, was then used to clone the next gene (i.e., crtB$_{syn}$). The GPDIN promoter and the Lip2 terminator were used for expression of crtB$_{syn}$ (SEQ ID NO:4). The GPDIN promoter from pYCRTE was isolated as a PmeI/NcoI fragment, while the Lip2 terminator was isolated as a ClaI/NotI fragment. The vector pYCRTE was isolated as a ClaI/PmeI fragment. A 4-way ligation and transformation, similar to that described above for synthesis of pYCRTE, was used to introduce the chimeric crtB$_{syn}$ gene (i.e., GPDIN::crtB$_{syn}$::Lip2).

Figure 6:
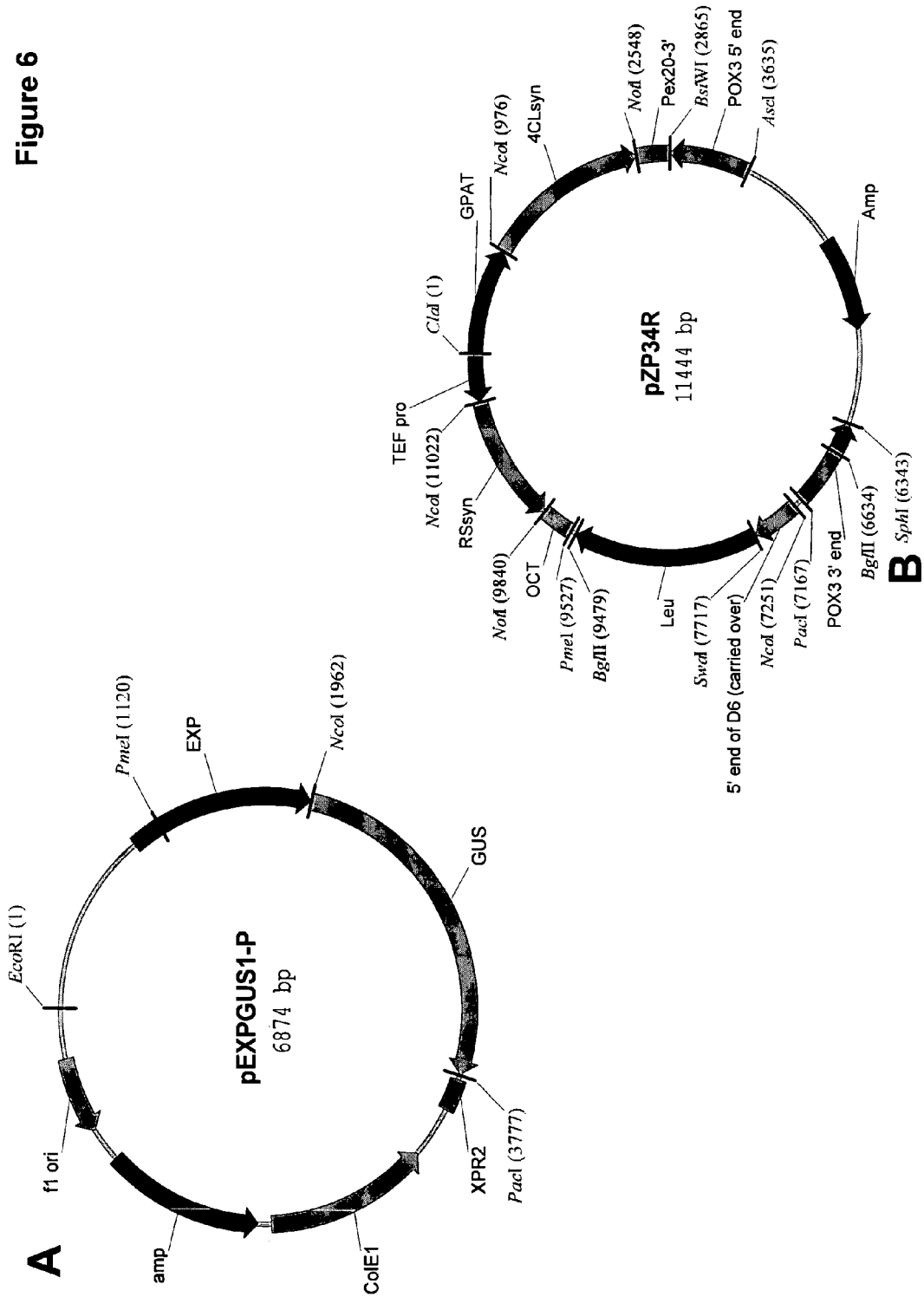
FIG. 6 provides plasmid maps for the following: (A) pEX-PGUS1-P; and, (B) pZP34R.

The resulting plasmid, pYCRTEB, was used to clone the last gene (i.e., crtI$_{syn}$; SEQ ID NO:6). The *Yarrowia lipolytica* export protein (EXP1) promoter (PCT Publication No. WO 2006/052870 and U.S. patent application Ser. No. 11/265, 761) was isolated from vector pEXPGUS1-P (SEQ ID NO:10; FIG. 6A) as a PmeI/NcoI fragment, while the OCT terminator of the *Yarrowia* OCT gene (GenBank Accession No. X69988) was isolated from vector pZP34R (SEQ ID NO:11; FIG. 6B) as a BglII/NotI fragment. The vector pYCRTEB was digested with PmeI and BglII and gel-purified with the BIO101® Kit (QBiogene). Again, a 4-way ligation and transformation procedure was utilized to introduce the chimeric EXP1::crtI$_{syn}$::Oct gene. Thus, the final plasmid construct pYCRTEBI (SEQ ID NO:12; FIG. 5), was created to thereby contain the following chimeric carotenoid biosynthesis genes: FBAIN::crtE$_{syn}$::Lip1, GPDIN::crtB$_{syn}$::Lip2 and EXP1::crtI$_{syn}$::Oct.

For integration into *Yarrowia lipolytica* strain Y2224, the pYCRTEBI plasmid was linearized (digested) with restriction enzymes SphI and AscI before transformation, according to the methodology of Example 1. After transformation, the cells were spread and grown on minimal plates without uracil and several colonies having red or orange color were selected for analysis. Red and orange transformants were streaked onto minimal plates and checked for stability and color intensity. One stable strain was designated as *Yarrowia lipolytica* strain YL5.

Characterization of Lycopene Production in *Y. lipolytica* Strain YL5

*Yarrowia lipolytica* strain YL5 was grown in 100 mL FM* in a 500 mL flask in a rotary shaker at 250 rpm. After 2 days of growth, 1 mL of cell culture was harvested by centrifugation at 12,000 rpm using a microcentrifuge. The cell pellet was extracted using the method described below for lycopene analysis. At the same time, 10 mL culture was collected in a 47 mm Nuclepore® Track-Etch polycarbonate membrane (0.2 µM, Whatman, Florham Park, N.J.) under vacuum for dry cell weight measurement.

To extract the pigments, the cell pellet was first resuspended by vortexing with a small amount of liquid remaining in the pellets. Next, 0.1 mm glass beads were added, followed by 2 mL of ethanol. The mixture was vortexed until the entire pellet dissolved. Next, 3 mL of dichloromethane was added and the samples were vortexed again for about 2 min. After centrifugation at 6600×g (room temperature) with a table top centrifuge for 10 min, the supernatant was transferred to a new 50 mL Corning® polypropylene centrifuge tube (Corning Inc., Corning, N.Y.) and was dried under a stream of nitrogen. The residue was dissolved completely in 90 µL chloroform followed by the addition of 1910 µL n-hexane (HPLC grade). Before injection into the HPLC, the samples were filtered with a 0.2 µm Gelman Teflon® filter (Pall Life Sciences, Ann Arbor, Mich.). The extract (20 µL) was analyzed using a HPLC system (Beckman, Fullerton, Calif.) equipped with a 250×4.6 mm Brownlee™, Spheri-5 silica, 5 µm, normal phase HPLC column (PerkinElmer, Norwalk, Conn.). The mobile phase consisted of 14% acetone and 86% n-hexane under isocratic conditions. The flow rate was 1.5 mL per min.

Figure 7:
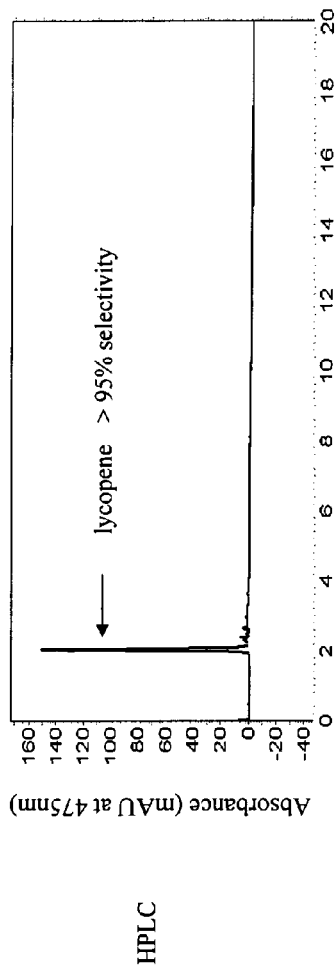
FIG. 7A is a HPLC profile of *Yarrowia lipolytica* strain YL5 illustrating the production of a carotenoid having the same retention time as lycopene.
FIG. 7B is the absorbance spectrum of the carotenoid produced by *Y. lipolytica* YL5 that is identical to the absorbance profile of the lycopene standard.
Figure 7:
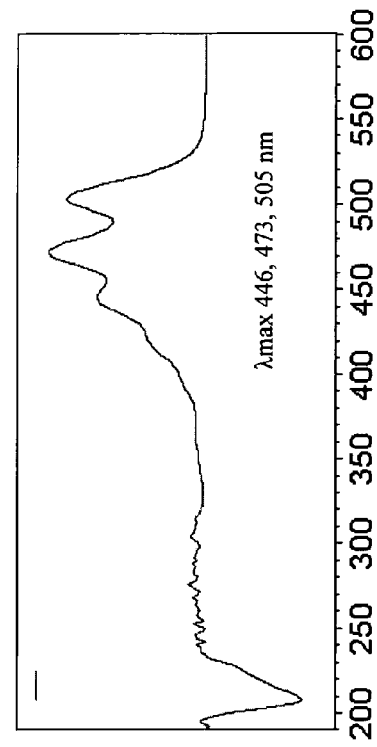

FIG. 7A shows the HPLC profile of the carotenoid product of strain YL5, comprising pYCRTEBI. The pigment from YL5 had the same retention time as the lycopene standard purchased from CaroteNature GmbH (Lupsingen, Switzerland). Furthermore, the pigment had the same absorbance profile characteristics of lycopene (FIG. 7B). The molecular weight of the extracted lycopene was confirmed by mass spectroscopy.

Co-Production of Oil and Lycopene in *Yarrowia lipolytica* Strain YL5

It is known that the oleaginous yeast *Yarrowia lipolytica* can accumulate significant amounts of oil, especially under nitrogen-limiting conditions. In order to investigate whether lycopene and oil could be co-produced in the same cell, strain YL5 was first grown for 2 days in a 500 mL flask with 100 mL in FM*. A portion of the culture (30 mL) was harvested by centrifugation at 4,000×g at room temperature and resuspended with 30 mL of oil induction medium ("OI" medium: 100 mM glucose, 50 mM potassium phosphate [pH 6.5]) without yeast nitrogen base (YNB) added. Another 30 mL of the culture was resuspended in OI medium with 6.7 g/L YNB added. The cultures were placed in 250 mL flasks and allowed to incubate at 30° C. with constant shaking at 225 rpm. Analytical samples were taken for lycopene and total oil analysis was conducted after 2 and 4 days of incubation. Results are shown in Table 9.

TABLE 9

Production Of Lycopene And Oil In Strain YL5 Under Different Growth Conditions

| Growth conditions | Total oil (% DCW) | Lycopene (mg g$^{-1}$ DCW) |
|---|---|---|
| Before induction | 4.0 | 374 |
| 2 days in OI medium | | |
| OI with YNB | 3.6 | 1.92 |
| OI without YNB | 7.5 | 1.60 |
| 4 days in OI medium | | |
| OI with YNB | 7.2 | 1.63 |
| OI without YNB | 12.5 | 1.33 |

Note:
Dry cell weight is abbreviated "DCW".

Strain YL5 accumulated more oil in OI medium without the YNB supplement. The amount of lycopene increased after 2 days of induction in OI medium with or without YNB added. After 4 days, the lycopene level dropped slightly, but it was still much higher than the level observed before the induction. The overall observation indicated that oil and lycopene could be co-produced in a recombinant oleaginous yeast.

Example 3

Synthesis of *Yarrowia lipolytica* Strains YCS1001-YCS1026, Producing Lycopene

The present Example describes the construction of lycopene-producing *Yarrowia lipolytica* strains YCS1001-YSC1026 (FIG. 8), by transformation and expression of plasmid pYCRTEBI (Example 2, supra) in *Y. lipolytica* strain Y2224 (i.e., a Ura⁻ derivative of *Y. lipolytica* ATCC #20362 [isolation described in Example 7]). Strain YCS1002 served as the host strain in Example 5, infra, for creation of the YCS1200 series of carotenoid-producing *Y. lipolytica* transformants, while strain YCS1013 served as the host strain in Example 5, infra, for creation of the YCS1300 series of carotenoid-producing *Y. lipolytica* transformants.

Specifically, additional pigmented, lycopene-producing *Y. lipolytica* strains were generated by transforming plasmid pYCRTEBI into *Y. lipolytica* strain Y2224, according to the methodology of Example 1. Strain Y2224 was separately transformed with pYCRTEBI two times (i.e., the "first" or "second" transformation, respectively herein). Following transformation, cells were plated onto MM+leucine (Leu) and colonies were visible after 2 days.

In the first transformation, 50 colonies were patched onto MM and MM+Leu agar plates. Twenty-two of the 50 patches from the first transformation were only able to grow on the MM+Leu plates, indicating that the cells were Leu⁻. In a second transformation, 11 of the 50 patches were only able to grow on the MM+Leu agar plates.

Ten colonies from each transformation were re-streaked onto the MM and MM+Leu agar plates. Leu⁻ cells were unable to grow on the MM plates and cells growing on the MM+Leu plates had very similar orange hues. The Leu+ cells appeared darker in color than the Leu⁻ cells.

From the first transformation, the 10 Leu⁻ transformants were named YCS1001 through YCS1010 and 2 Leu+ transformants were named YCS1021 and YCS1022.

From the second transformation, the 10 Leu⁻ transformants were named YCS1011 through YCS1020 and the 4 Leu+ transformants were named YCS1023 through YCS1026.

The Ura marker was removed from 6 of the dark orange *Yarrowia* strains (i.e., YCS1021, YCS1022, YCS1023, YCS1024, YCS1025 and YCS1026) containing the crtE$_{syn}$, crtB$_{syn}$ and crtI$_{syn}$ carotenoid genes, as described below. Specifically, *Yarrowia* cells were streaked onto fresh YPD plates and incubated at 30° C. for 1 day. Then, cells were transformed using the methodology of Example 1 with 1 μL of replicating plasmid pY79. Plasmid pY79 (FIG. 9A; SEQ ID NO:13) contained the following components:

TABLE 10

Components of Plasmid pY79 (SEQ ID NO: 13)

| RE Sites And Nucleotides Within SEQ ID NO: 13 | Description Of Fragment And Chimeric Gene Components |
|---|---|
| 4329-7315 | *Yarrowia lipolytica* AHAS gene comprising a W497L mutation (confers sulfonylurea resistance) (SEQ ID NO: 1; GenBank ® Accession No. XM_501277; PCT Publication No. WO 2006/052870) |
| 7362-1 | TEF::Cre::XPR, comprising:<br>TEF: *Yarrowia* TEF promoter (GenBank ® Accession No. AF054508);<br>Cre: Enterobacteria phage P1 Cre gene for recombinase protein (GenBank ® Accession No. X03453);<br>XPR: XPR terminator sequence comprising ~100 bp of the 3' region of the *Yarrowia* Xpr gene (GenBank ® Accession No. M17741) |

For transformation, the cells and pY79 were incubated at 39° C. for 1 hr, with vortexing every 15 min. Cells were then plated onto MMU+SU agar plates and incubated at 30° C. for 2-3 days.

It was observed that the color intensity of the colonies decreased when the Ura marker was removed. It was also observed that colonies from strain YCS1026 were white upon Ura marker removal, suggesting that the integration of the carotenoid genes in this strain was unstable. The lycopene-producing strains that were evaluated via HPLC analysis for their carotenoid profile were YCS1007 (Leu) and YCS1021, YCS1023, YCS1024 and YCS1025. All strains were confirmed to produce lycopene.

Example 4

Preparation of Promoter and Terminator Fragments for Construction of *Yarrowia lipolytica* Integration Vectors Comprising Carotenoid Biosynthetic Genes The present Example describes the preparation of various *Yarrowia lipolytica* promoters and terminators, that would subsequently be used in Examples 5, 6, 10, 11 and 12 for construction of various integration vectors comprising carotenoid biosynthetic genes.

Figure 9:
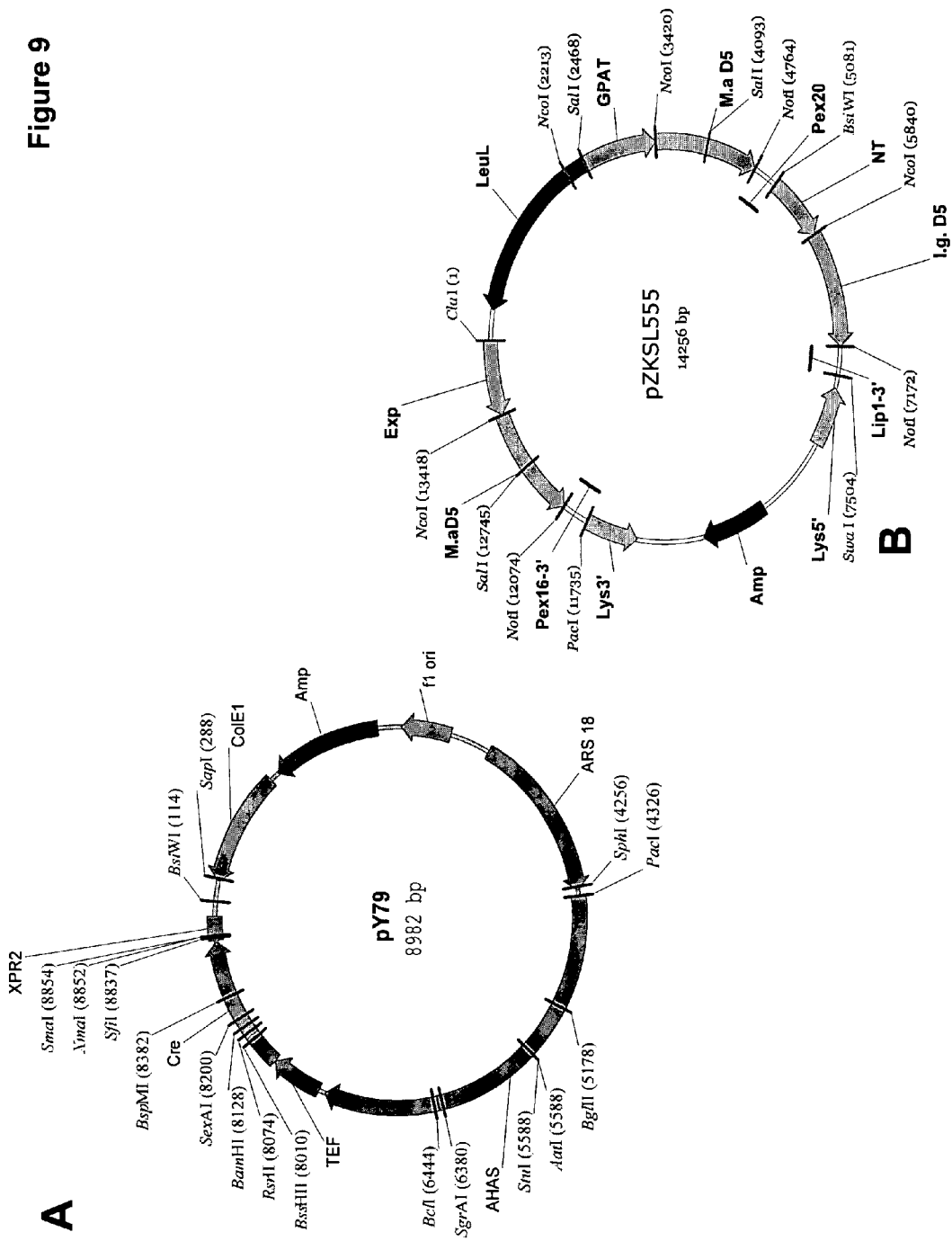
FIG. 9 provides plasmid maps for the following: (A) pY79; and, (B) pZKSL555.

Vector pZKSL555 (FIG. 9B; SEQ ID NO:14) was previously constructed for expression of 3 heterologous Δ5 desaturases in *Yarrowia lipolytica*, and contained the components listed below in Table 11.

TABLE 11

| Components Of Plasmid pZKSL555 (SEQ ID NO: 14) | |
|---|---|
| RE Sites And Nucleotides Within SEQ ID NO: 14 | Description of Fragment and Chimeric Gene Components |
| PacI/ClaI (11735-1) | EXP1::M.Ad5::Pex16, comprising<br>EXP1: *Yarrowia lipolytica* export protein (EXP1) promoter (labeled as "Exp" in Figure; PCT Publication No. WO 2006/052870 and U.S. Patent Application No. 11/265,761);<br>M.Ad5: codon-optimized Δ5 desaturase, derived from *Mortierella alpina* (GenBank ® Accession No. AF067654);<br>Pex16: Pex16 terminator sequence from *Yarrowia* Pex16 gene (GenBank ® Accession No. U75433) |
| SalI/BsiWI (2468-5081) | GPAT::M.Ad5::Pex20, comprising<br>GPAT: *Yarrowia lipolytica* GPAT promoter (PCT Publication No. WO 2006/031937 and U.S. Pat. No. 7,264,949);<br>M.Ad5: codon-optimized Δ5 desaturase, derived from *Mortierella alpina* (GenBank ® Accession No. AF067654); Pex20: Pex20 terminator sequence of *Yarrowia lipolytica* Pex20 gene (GenBank ® Accession No. AF054613) |
| BsiWI/SwaI (5081-7504) | YAT1::I.g.D5::Lip1, comprising<br>YAT1: *Yarrowia lipolytica* YAT1 promoter (labeled as "NT" in Figure; Patent Publication US 2006/0094102-A1);<br>I.g.D5: codon-optimized Δ5 desaturase gene, derived from *Isochrysis galbana* (PCT Publication No. WO 2002/081668);<br>Lip1: Lip1 terminator sequence from *Yarrowia* Lip1 gene (GenBank ® Accession No. Z50020) |

Various promoter and terminator elements were isolated from pZKSL555 via enzymatic digestions. In the initial digestion, pZKSL555 was digested with PacI and ClaI. The 2.5 kb PacI/ClaI fragment was digested with NcoI or NotI to prepare fragments comprising either: (a) the EXP1 promoter; or, (b) the Pex16 terminator. The EXP1 promoter fragment was 839 bp and the Pex16-3' terminator fragment was 339 bp.

Plasmid pZKSL555 was also subjected to BsiWI/SwaI digestion, resulting in production of 11.7 kb and 2.4 kb DNA fragments. The 2.4 kb DNA fragment was excised from the agarose gel, purified and subsequently digested with NcoI, which produced two DNA fragments (i.e., 1.6 kb and 0.8 kb). The 0.8 kb DNA fragment contained the YAT1 promoter. The 2.4 kb DNA fragment was also digested with NotI, thereby generating 2.1 kb and 0.3 kb DNA fragments. The 0.3 kb DNA fragment, which contained the Lip1 terminator (332 bp), was excised from the agarose gel and purified.

Digestion of pZKSL555 with BsiWI and SalI resulted in the production of four DNA fragments (i.e., 7.7 kb, 4.0 kb, 1.6 kb and 1.0 kb). The 1.6 kb and the 1.0 kb DNA fragments were excised from the agarose gel and purified. Further digestion of the 1.6 kb DNA fragment with NcoI generated two DNA fragments (i.e., ~1.0 kb and 0.7 kb). The ~1.0 kb fragment containing the GPAT promoter was excised from the agarose gel and purified. Further digestion of the 1.0 kb BsiWI/SalI DNA fragment with NotI generated two more fragments (i.e., 0.7 kb and 0.3 kb). The 0.3 kb fragment, which contained the Pex20 terminator, was excised from the agarose gel and purified. All DNA fragment purification from the agarose gels was done using the Geneclean® II kit.

Example 5

Figure 8:
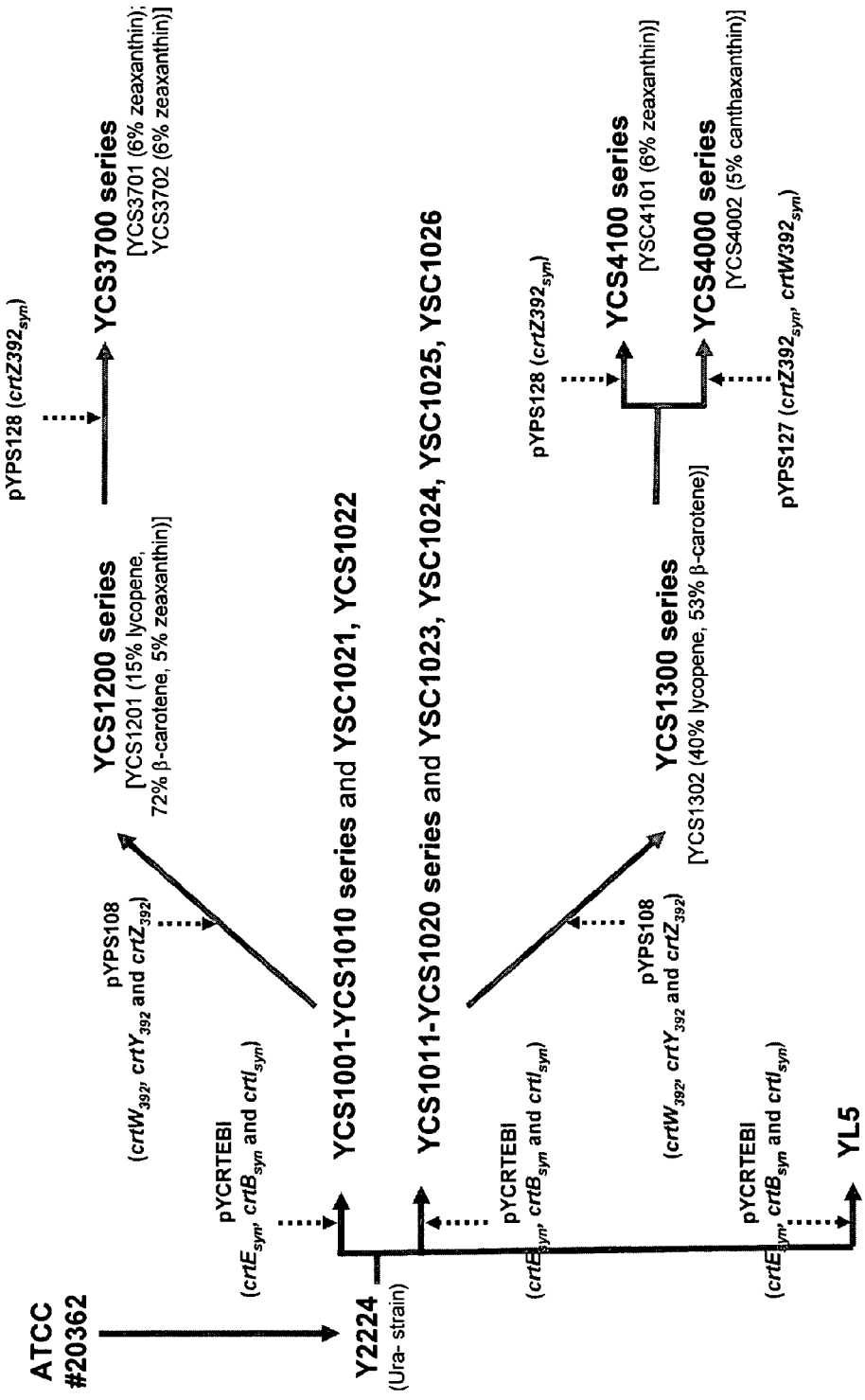
FIG. 8 diagrams the development of some *Yarrowia lipolytica* strains producing various carotenoids.

Synthesis of *Yarrowia lipolytica* Strain Series YCS1200 and Series YCS1300, Producing Primarily β-Carotene The present Example describes the construction of β-carotene-producing *Yarrowia lipolytica* strains, identified herein as the YCS1200 series and the YCS1300 series (FIG. 8). Strain YCS1205 served as the host strain in Example 6, infra, for creation of the YCS3700 series of carotenoid-producing *Y. lipolytica* transformants, while strain YCS1306 served as the host strain in Example 6, infra, for creation of the YCS4000 and YCS4100 series of carotenoid-producing *Y. lipolytica* transformants.

As described herein, construction of the *Y. lipolytica* YCS1200 series and the YCS1300 series required: (1) preparation of wildtype crtY, crtZ and crtW genes for subsequent cloning; (2) synthesis of pYPS106, comprising a crtY gene; (3) synthesis of pYPS107, comprising a crtY gene and a crtZ gene; (4) synthesis of pYPS108, comprising a crtY gene, a crtZ gene and a crtW gene; (5) transformation of lycopene-producing *Yarrowia* strains with integration plasmid pYPS108; and, (6) extraction and analysis of the carotenoids produced.

Cloning Wildtype crtY, crtZ and crtW Genes

Production of astaxanthin requires crtY, crtW, and crtZ genes, which encode lycopene cyclase (CrtY), carotenoid ketolase (CrtW), and carotenoid hydroxylase (CrtZ), respectively.

Integration plasmid pYPS108 was constructed to contain wildtype crtY, crtZ, and crtW genes from plasmid pDCQ392 (SEQ ID NO:15). Plasmid pDCQ392 comprises the carotenoid gene cluster identified as "DCQ392", which comprises the gene cluster crtWZEidiYIB. The crtW gene in DCQ392 (herein referred to as $crtW_{392}$; SEQ ID NO:16) is from *Brevundimonas vesicularis* DC263 (U.S. Pat. No. 7,252,985). The crtZ gene in DCQ392 (herein referred to as $crtZ_{392}$; SEQ ID NO:18) is from *Brevundimonas vesicularis* DC263 (U.S. Pat. No. 7,091,031). The crtEidiYIB carotenoid biosynthesis "backbone" genes from DCQ392 are from the *Pantoea stewartii* DC413 (U.S. Pat. No. 7,288,387). Hereinafter, the crtY gene from the DCQ392 carotenoid cluster will be referred to herein as $crtY_{392}$; SEQ ID NO:20).

Each of the crt genes described above was PCR amplified from pDCQ392 using primers that added NcoI and NotI sites to the ends of each gene. Specifically, $crtY_{392}$ was amplified with the forward and reverse primers set forth as SEQ ID NOs:22 and 23, $crtZ_{392}$ was amplified with the forward and reverse primers set forth as SEQ ID NOs:24 and 25, and $crtW_{392}$ was amplified with the forward and reverse primers set forth as SEQ ID NOs:26 and 27.

All three PCR products were ligated into pCR®2.1-TOPO® using the TOPO TA Cloning® Kit (Invitrogen, Carlsbad, Calif.). Each gene was subsequently excised from the pCR®2.1-TOPO® derived vector by digestion with NcoI and NotI. The TOPO plasmids containing crtY$_{392}$ had DNA fragments that were 2.3 kb, 1.6 kb and 1.2 kb. The crtY$_{392}$ gene was present on the 1.2 kb DNA fragment. The TOPO plasmids containing crtW$_{392}$ had DNA fragments that were 2.3 kb, 1.6 kb and 0.78 kb; the crtW$_{392}$ gene was located on the 0.78 kb DNA fragment. The TOPO plasmids containing crtZ$_{392}$ also had three fragments (i.e., 2.3 kb, 1.6 kb and 0.5 kb) when digested with NcoI and NotI; the 0.5 kb DNA fragment contained the crtZ$_{392}$ gene.

Synthesis of pYPS106, Comprising a crtY$_{392}$ Gene

The EXP1 promoter and the Pex16 terminator were ligated to the 5' and 3' ends of the crtY$_{392}$ coding sequence (SEQ ID NO:20), respectively, in a four-way ligation reaction creating the chimeric EXP1::crtY$_{392}$::Pex16 gene. The ligation reaction included an 11.7 kb PacI/ClaI DNA fragment from pZKSL555, a ClaI/NcoI DNA fragment containing the EXP1 promoter, a NcoI/NotI DNA fragment comprising the crtY$_{392}$ coding sequence and a NotI/PacI DNA fragment including the Pex16-3' terminator. The ligation reaction was transformed into *E. coli* XL2 Blue cells and the transformation mixture was streaked onto LB agar plates containing 100 mg/L ampicillin (i.e., LBA+Amp$^{100}$ agar plates).

Approximately 30 colonies were screened via PCR amplification to verify the construction of plasmid pYPS106, using PCR primers Exp-forward (SEQ ID NO:28) and HY-339 reverse (SEQ ID NO:29).

The PCR reaction comprised the MasterAmp™ Taq (Epicentre) components described in the General Methods and a single colony. The PCR reaction was run using the following PCR parameters: 94° C. for 5 min (1 cycle); 94° C. for 30 sec, 60° C. for 1 min, 72° C. for 1 min (30 cycles); and 72° C. for 6 min (1 cycle).

Seven of the samples produced a PCR fragment of the expected size of 1.4 kb. The plasmid DNA was extracted from cells and confirmed to be correct by digestion with MluI and ClaI. The vectors having the correct insert DNA fragment generated 3 bands upon digestion that were 9.6 kb, 3.6 kb and 1.0 kb in size. This plasmid was named pYPS106 (SEQ ID NO:30).

Synthesis of pYPS107, Comprising a crtY$_{392}$ Gene and a crtZ$_{392}$ Gene

Plasmid pYPS106 was digested with BsiWI and SwaI and the 11.7 kb DNA fragment was excised from the agarose gel. This 11.7 kb fragment served as the vector backbone in a four-way ligation reaction that created a chimeric YAT1::crtZ$_{392}$::Lip1 gene in pYPS107. Specifically, the four-way ligation reaction comprised: the vector backbone, the BsiWI/NcoI digested YAT1 promoter, the NcoI/NotI digested crtZ$_{392}$ coding sequence (SEQ ID NO:18) and the NotI/SwaI digested Lip1 terminator. The ligation mixture was used to transform *E. coli* XL2 Blue cells which were streaked onto LB+Amp$^{100}$ agar plates. Twenty-four colonies were evaluated for the correct insert DNA fragment using the PCR methodology described above for pYPS106 and PCR primers NT forward (SEQ ID NO:31) and Lip1-3' reverse (SEQ ID NO:32).

A 2.1 kb PCR fragment was generated if the cells contained the parental vector pYPS106. However, cells having plasmids with the correct insert DNA fragment generated PCR fragments that were 1.1 kb. The PCR results were confirmed via restriction digestion of plasmid DNA using BsiWI and SwaI. This new vector, comprising a chimeric EXP1::crtY$_{392}$::Pex16 gene and a chimeric YAT1::crtZ$_{392}$::Lip1 gene, was named pYPS107 (SEQ ID NO:33).

Synthesis of pYPS108, Comprising A crtY$_{392}$ Gene, A crtZ$_{392}$ Gene and a crtW$_{392}$ Gene Plasmid pYPS107 was digested with BsiWI and SwaI to prepare a vector backbone for the final four-way ligation reaction required to incorporate the third carotenoid gene, crtW$_{392}$ (SEQ ID NO:16), into the vector as a chimeric GPAT::crtW$_{392}$::Pex20 gene. The other DNA fragments included in this four-way ligation reaction were: a SalI/NcoI digested DNA fragment containing the GPAT promoter, the NcoI/NotI digested DNA fragment containing the crtW$_{392}$ coding sequence, and a NotI/BsiWI digested DNA fragment containing the Pex20 terminator. The ligation mixture was used to transform *E. coli* XL2 Blue cells, which were streaked onto LB+Amp$^{100}$ agar plates.

Several of the colonies were screened to identify those having the correct insert DNA fragment via a modified PCR methodology with respect to that used for pYPS106. Specifically, the components of the PCR reaction were the same as described for pYPS106, with the exception that DNA primers GPAT forward (SEQ ID NO:34) and Pex20 reverse (SEQ ID NO:35) were utilized. The PCR parameters were: 94° C. for 5 min (1 cycle); 94° C. for 30 sec, 60° C. for 1 min, 72° C. for 90 sec (30 cycles); and 72° C. for 6 min (1 cycle).

Figure 10:
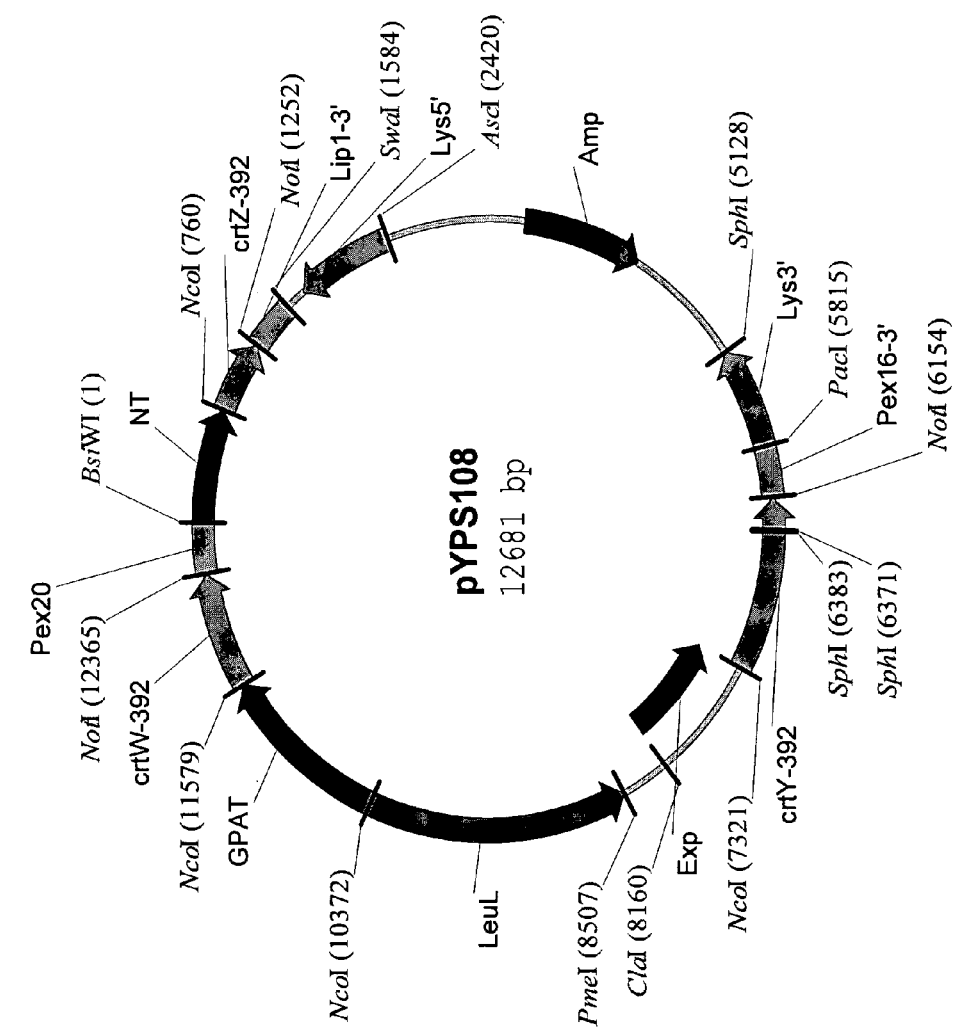
FIG. 10 provides a plasmid map for pYPS108.

The PCR products were evaluated on an agarose gel and a 1.6 kb band was detected for samples having the correct insert DNA fragment. These plasmid vectors were confirmed to have the correct insert DNA fragments by restriction digests. Specifically, the plasmid containing the chimeric GPAT::crtW$_{392}$::Pex20 gene plus the pYPS107 vector backbone generated two fragments (i.e., 10.6 kb and 2.1 kb) upon digestion with BsiWI and SalI. This plasmid was named pYPS108 (SEQ ID NO:36; FIG. 10) and thereby comprised the following chimeric carotenoid biosynthetic genes: EXP1::crtY$_{392}$::Pex16, YAT1::crtZ$_{392}$::Lip1 and GPAT:crtW$_{392}$::Pex20.

Transformation of a Lycopene-Producing *Yarrowia* Strain with Integration Plasmid pYPS108

To prepare pYPS108 (SEQ ID NO:36) for transformation into *Yarrowia*, the plasmid DNA was linearized by digestion with AatII and AscI. The linearized plasmid DNA was transformed into YCS1002 and YCS1013, both strains (isolates) comprising the crtE$_{syn}$, crtB$_{syn}$ and crtI$_{syn}$ genes integrated at the leucine chromosomal site (Example 3). The transformation was carried out according to Example 1. The transformation mixture was streaked onto MMLys agar plates. Colonies resulting from this transformation were a part of the YCS1200 series (if derived from YCS1002) and the YCS1300 series (if derived from YCS1013). Eight colonies were patched onto MM and MMLys to determine if the plasmid had integrated at the lysine site or elsewhere within the host chromosome. All 8 colonies were able to grow on both mediums, indicating that integration had not occurred at the lysine loci.

The ura marker was removed from YCS1201 and YCS1302 transformants via transformation with pY79 (Example 3). Four colonies from each transformation were grown in MMLeuLysUra medium and streaked onto MMU agar plates. Forty colonies were patched onto MM, MMU+SU, and MMU. Some of the colonies were unable to grow on the MM agar plates, suggesting that the ura marker had been removed (cells were thus auxotrophs for uracil). Approximately 25% of the colonies were unable to grow on plates containing SU, suggesting that cells had lost the plasmid expressing the Cre recombinase. One YCS1200 series colony selected for further analysis was named YCS1205 and its phenotype was ura⁻ Leu⁺ Lys⁺. Similarly, one YCS1300 colony that was ura⁻ Leu⁺ Lys⁺ was chosen for further analysis and was named YCS1306.

Carotenoid Extraction and Analysis

Individual colonies were inoculated into a 24-well block containing 700 µL of MMLeuLysUra medium and were grown overnight with aeration. From these seed cultures, 20 mL of YPD medium was inoculated to a starting $OD_{600}$ of 0.05. Following ~40 hr of growth, 2 mL was removed and the cells were harvested by centrifugation. After disrupting the cell pellets by dragging the microcentrifuge tube across a rack, 400 µL of a 1% sodium methoxide solution and 100 µL of 0.5 mm glass beads were added to the cells. The mixture was agitated in a BeadBeater™ apparatus (BioSpec Products, Bartlesville, Okla.) for 5 min at high speed, followed by mixing on a rocking platform for 20 min. Afterwards, 50 µL of a 1.0 M NaCl solution was added to the disrupted cells. In addition, 200 µL of chloroform and 400 µL of hexane were added and were mixed together by vortexing. The solution was separated into layers by a 3 min centrifugation. The upper organic layer was removed using a glass Pasteur pipette. The extract was subsequently placed into a syringe and was filtered into a small glass vial containing an insert for small samples using a 0.2 µm Teflon® filter (Pall Corp., Ann Arbor, Mich.). The carotenoid extracts were analyzed via HPLC using the following conditions. Specifically, each carotenoid extract (20 µL) was analyzed using a HPLC system (Agilent Technologies, Palo Alto, Calif.) equipped with an Agilent Technologies Zorbax $C_{18}$ reverse phase column. The mobile phase consisted of 2 solvents in an isocratic method: 95% acetonitrile/5% water and 100% tetrahydrofuran (THF). The flow rate was 1.0 mL per min. The column was run at room temperature for 20 min. Results are shown below in Table 12.

TABLE 12

Carotenoid Analysis Of Selected Carotenoid-Producing Isolates

| Strain Designation | Carotenoid Produced | Percentage of Total Carotenoids Produced |
|---|---|---|
| YCS1201 | lycopene | 15% |
|  | β-carotene | 72% |
|  | zeaxanthin | 5% |
| YCS1302 | lycopene | 40% |
|  | β-carotene | 53% |

Results showed that the primary carotenoid product in strains of the YSC1200 and YSC1300 series was β-carotene, with the secondary product as primarily lycopene. This observation was despite the presence of the $crtY_{392}$, $crtZ_{392}$ and $crtW_{392}$ genes, which could theoretically enable astaxanthin production. It was assumed that the conversion efficiency of the $crtZ_{392}$ and $crtW_{392}$ genes was extremely limited.

Example 6

Synthesis of *Yarrowia lipolytica* Strain Series YCS3700, Series YCS4000 and Series YCS4100, Producing Primarily Canthaxanthin and Zeaxanthin The present Example describes the construction of canthaxanthin- and zeaxanthin-producing *Yarrowia lipolytica* strains, identified herein as the YCS3700 series, the YCS4000 series and the YCS4100 series (FIG. 8). These strains were derived from strains of the YSC1200 and YSC1300 series, following transformation with additional copies of crtZ and crtW genes.

As described herein, construction of the *Yarrowia lipolytica* YCS3700 series, the YCS4000 series and the YCS4100 series required: (1) synthesis of codon-optimized $crtW_{syn}$ and $crtZ_{syn}$ genes; (2) synthesis of pYPS127, comprising a codon-optimized $crtW_{syn}$ gene; (3) synthesis of pYPS128, comprising a codon-optimized $crtZ_{syn}$ gene; (4) transformation of primarily β-carotene-producing *Yarrowia* strains; and, (5) extraction and analysis of the carotenoids produced.

Synthesis of Synthetic Codon-Optimized crtY, crtZ and crtW Genes

The wildtype $crtY_{392}$, $crtZ_{392}$ and $crtW_{392}$ genes (Example 5) were codon-optimized for expression in *Yarrowia*, thus resulting in creation of the synthetic codon-optimized $crtY392_{syn}$, $crtW392_{syn}$ and $crtZ392_{syn}$ genes, as described below in Table 13. The codon-optimized genes were synthesized by GenScript Corp. (Piscataway, N.J.) and each provided in the high-copy vector pUC57 (GenBank® Accession No. Y14837).

TABLE 13

Codon-Optimized Carotenoid Biosynthesis Genes

| Carotenoid Gene (Original Source) | Nucleotide SEQ ID NO | Amino Acid SEQ ID NO |
|---|---|---|
| $crtY392_{syn}$ (*Pantoea stewartii* DC413; U.S. Pat. No. 7,288,387) | 37 | 38 |
| $crtW392_{syn}$ (*Brevundimonas vesicularis* DC263; U.S. Pat. No. 7,252,985) | 39 | 40 |
| $crtZ392_{syn}$ (*Brevundimonas vesicularis* DC263; U.S. Pat. No. 7,091,031) | 41 | 42 |

Synthesis of Vector pYPS127 and pYPS128 for Expression of $crtZ392_{syn}$ and $crtW392_{syn}$ Genes Integration plasmids pYPS127 and pYPS128 were constructed to contain the synthetic $crtZ392_{syn}$ or $crtW392_{syn}$ genes. In preparation for the ligation reaction, both of the genes were excised from the pUC57 derived vector by digestion with NcoI and NotI. The DNA fragments were run on a 0.8% agarose gel. A 0.5 kb DNA fragment was excised for the $crtZ392_{syn}$ reaction; and, a 0.8 kb DNA fragment was excised for the $crtW392_{syn}$ reaction. The DNA was extracted and purified from the agarose using the Qbiogene Geneclean® kit.

The promoter FBAIN used in the construction of pYPS127 and pYPS128 was taken from plasmid pZKLeuN-6EP (SEQ ID NO:8; Example 2), which was digested with NcoI and BglII. An ~1.0 kb DNA fragment was excised from the 0.8% agarose gel containing the FBAIN promoter fragment. The vector backbone corresponded substantially to the SwaI/NotI portion of pZKLeuN-6EP; however, intervening cloning (not described herein) had added additional nucleotides upstream of the SwaI restriction site resulting in a BglII site. Thus, the vector backbone was a BglII/NotI fragment. The Lip2 terminator was present on the 6.5 kb DNA fragment comprising the vector backbone.

Two three-way ligation reactions were set-up. In one reaction, the DNA fragments were: the BglII/NotI-digested vector backbone and the Lip2 terminator, the BglII/NotI FBAIN promoter, and the NcoI/NotI $crtW392_{syn}$ gene. In another reaction, the DNA fragments were: the BglII/NotI-digested vector backbone and the Lip2 terminator, the BglII/NotI FBAIN promoter, and the NcoI/NotI $crtZ392_{syn}$ gene.

The ligation reactions were carried out at room temperature for 3 hr. The ligation mixtures were used to transform *E. coli* XL2 Blue cells (Stratagene). The transformation mixtures were streaked onto LB+Amp[100] agar plates. Sixteen colonies were picked from each transformation and were checked by colony PCR to identify colonies containing plasmids with the correct insert DNA fragments. The PCR results for all 16 colonies were positive for the expected DNA fragments. Four colonies from each transformation were grown overnight in 4 mL of LB broth at 37° C. with aeration. The plasmid DNA was purified from cells and was confirmed to have the correct configuration by digestion with BamHI and NotI. The digestion reactions were evaluated on a 0.8% agarose gel.

Figure 11:
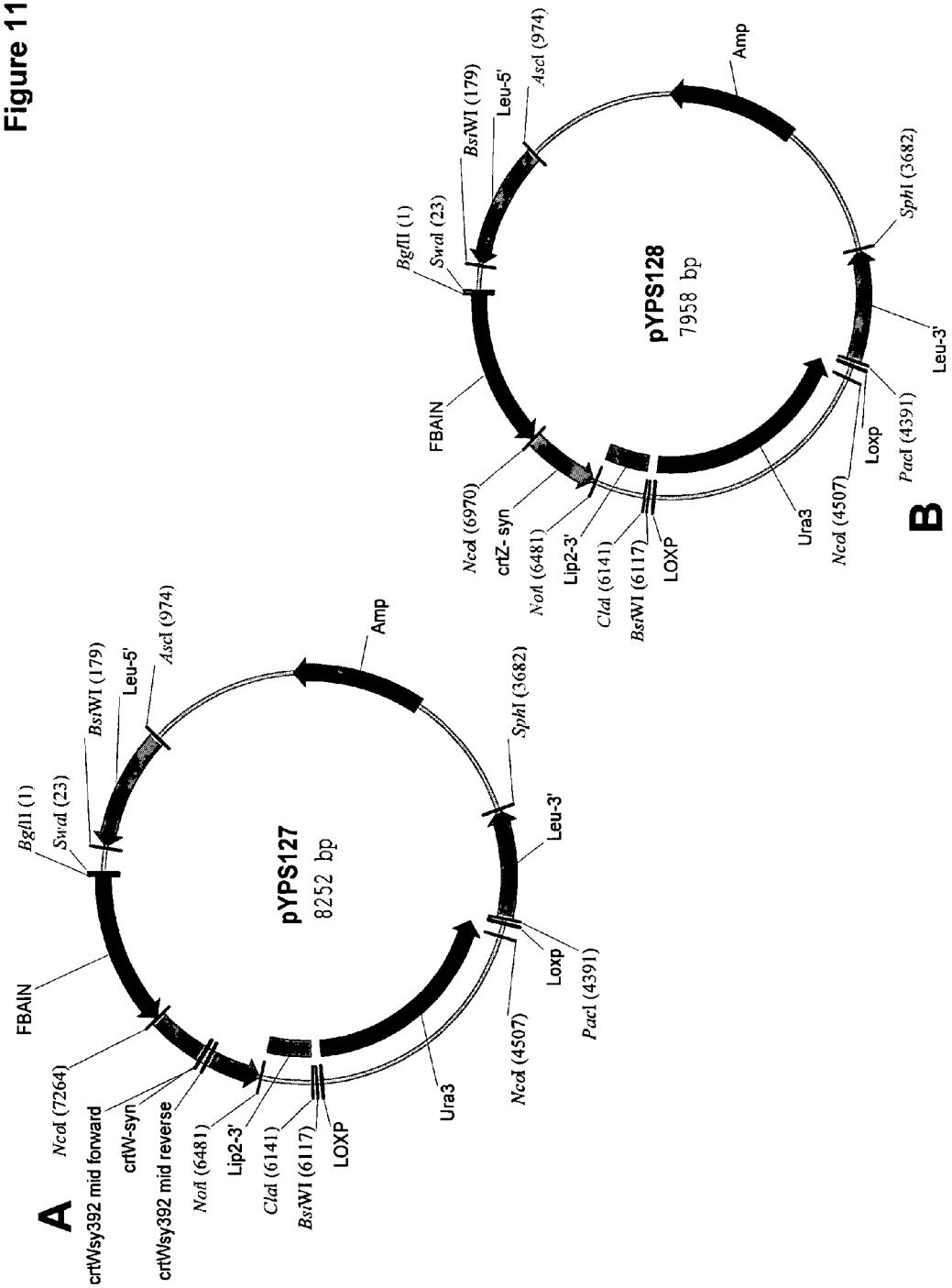
FIG. 11 provides plasmid maps for the following: (A) pYPS127; and, (B) pYPS128.

For plasmids containing the vector backbone with the newly constructed chimeric FBAIN::crtW392$_{syn}$::Lip2 gene, 2 DNA fragments were expected having sizes of 7.7 kB and 0.5 kB. Plasmids having this configuration were named pYPS127 (SEQ ID NO:43; FIG. 11A).

Those plasmids containing the vector backbone and the newly constructed chimeric FBAIN::crtZ392$_{syn}$:Lip2 gene were expected to yield a single DNA fragment that was 7.9 kB upon digestion with BamHI and NotI. The plasmid having this configuration was named pYPS128 (SEQ ID NO:44; FIG. 11B).

Transformation of β-Carotene-Producing *Yarrowia* Strains with Integration Plasmids pYPS127 and pYPS128

Two Ura−, β-carotene-producing strains from the YCS1200 and YCS1300 series of transformants (i.e., YCS1205 and YCS1306, respectively) were selected as hosts for transformations with the crtW392$_{syn}$ and crtZ392$_{syn}$ genes to result in canthaxanthin and zeaxanthin producing strains.

To facilitate the integration of the carotenoid genes into the *Yarrowia* chromosome, pYPS127 and pYPS128 were linearized by digestion with AscI and SphI. The *Yarrowia* strains were transformed as described in Example 1 and several colonies were selected and re-streaked onto MMLeu agar plates. Strain YCS1205 was transformed with linearized pYPS128 to generate the YCS3700 series; strain YCS1306 was transformed with linearized pYPS127 to generate the YCS4000 series; and, strain YCS1306 was transformed with linearized pYPS128 to generate the YCS4100 series.

For the YCS3700 series, 4 orange and 5 yellow colonies were patched onto MM and MMLeu agar plates to determine if the crtW392$_{syn}$ gene had integrated at the leucine site. In the case of the YCS4000 series, 5 orange and 4 yellow colonies were evaluated. Two orange and 7 yellow colonies from the YCS4100 series were also evaluated on the MM and MMLeu agar plates.

Select strains from each series were selected for further analysis. YCS3701 and YCS3702 grew on both the MM and MMLeu plates, suggesting that the crtZ392$_{syn}$ gene did not integrate at the leucine site. Strain YCS4002 was unable to grow on the MM agar plates, suggesting that the crtW392$_{syn}$ gene had integrated at the leucine site and thereby inactivated the leucine gene added during the second transformation with pYPS108. Strain YCS4101, transformed with the crtZ392$_{syn}$ gene, was also the result of random integration as indicated by its ability to grow on both the MM and MMLeu agar plates. These 4 strains (i.e., YCS3701, YCS3702, YCS4002 and YCS4101) were evaluated by HPLC analysis.

Carotenoid Extraction and Analysis

*Yarrowia* strains engineered to produce canthaxanthin and zeaxanthin were analyzed using the carotenoid extraction protocol described above (Example 5). Using HPLC analysis, carotenoids that absorb at 450 nm were evaluated. The elution time, mass of carotenoid and UV absorption spectrum corresponded to the canthaxanthin and zeaxanthin standards (CaroteNature GmbH). Results are shown below in Table 14.

TABLE 14

Carotenoid Analysis Of Selected Strains Of The YCS3700, YCS4000 And YCS4100 Series

| Strain | Plasmid Used to Transform (crt biosynthesis gene) | Xanthophyll Produced (% of total carotenoid) |
|---|---|---|
| YCS3701 | pYPS128 (crtZ392$_{syn}$) | 6% zeaxanthin |
| YCS3702 | pYPS128 (crtZ392$_{syn}$) | 4% zeaxanthin |
| YCS4002 | pYPS127 (crtW392$_{syn}$) | 5% canthaxanthin |
| YCS4101 | pYPS128 (crtZ392$_{syn}$) | 6% zeaxanthin |

Example 7

Figure 12:
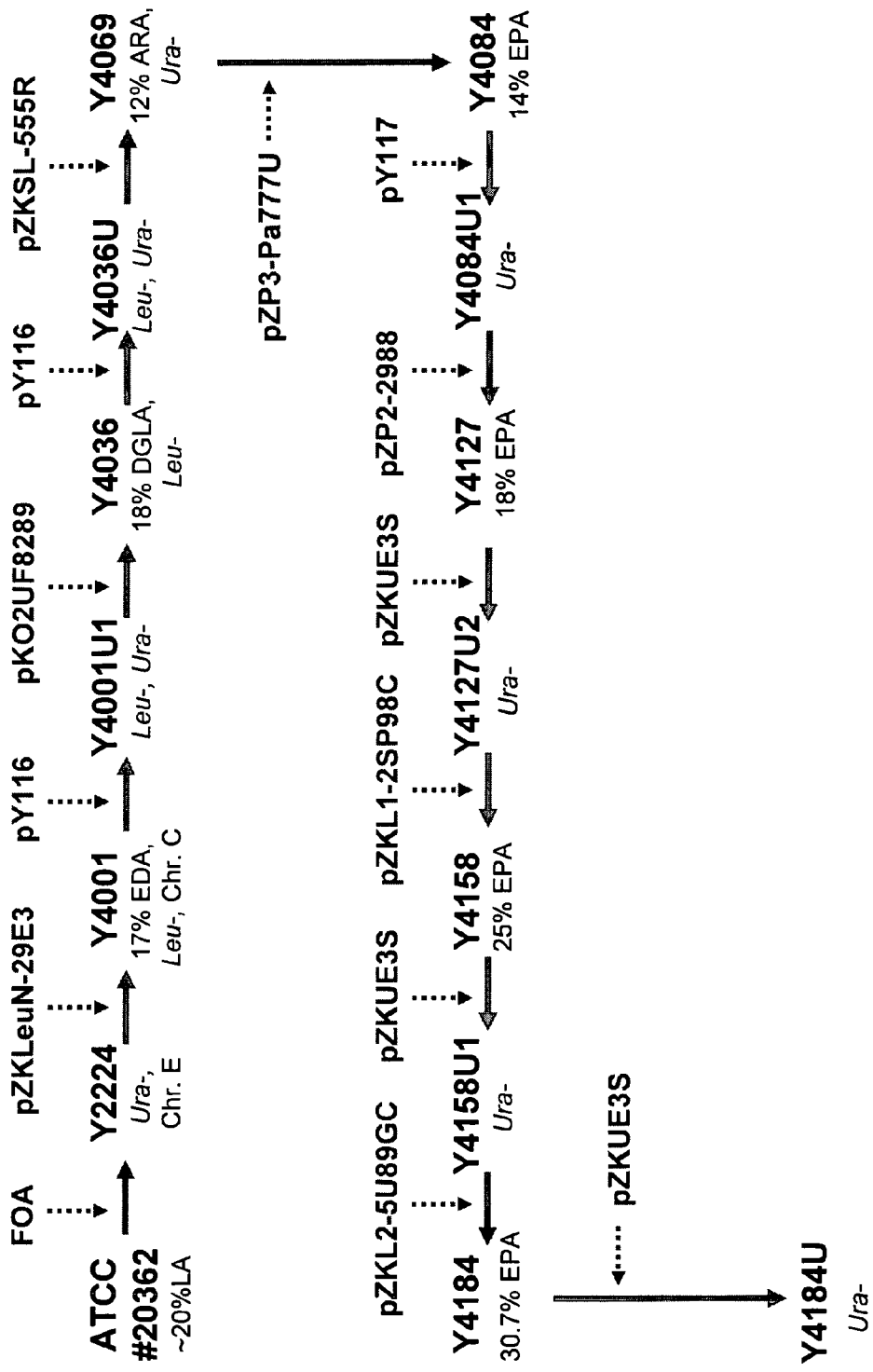
FIG. 12 diagrams the development of *Yarrowia lipolytica* strain Y4184U, producing about 31% EPA in the total lipid fraction.

Generation of *Yarrowia lipolytica* Strain Y4184U to Produce About 31% EPA of Total Lipids Via the Δ9 Elongase/Δ8 Desaturase Pathway The present Example describes the construction of strain Y4184U, derived from *Yarrowia lipolytica* ATCC #20362, capable of producing about 31% EPA relative to the total lipids via expression of a Δ9 elongase/Δ8 desaturase pathway (FIG. 12). The strain has a Ura− phenotype.

The development of strain Y4184U required the construction of strain Y2224 (a FOA resistant mutant from an autonomous mutation of the Ura3 gene of wildtype *Yarrowia* strain ATCC #20362), strain Y4001 (producing EDA with a Leu− phenotype), strain Y4001U (Leu−, Ura−), strain Y4036 (producing DGLA with a Leu− phenotype), strain Y4036U (Leu−, Ura−), strain Y4069 (producing ARA with a Ura− phenotype), strain Y4084 (producing EPA), strain Y4084U1 (Ura−), strain Y4127 (producing EPA), strain Y4127U2 (Ura−), strain Y4158 (producing EPA), strain Y4158U1 (Ura−) and strain 4184 (producing 30.7% EPA).

Generation of Strain Y2224

Strain Y2224 was isolated in the following manner: *Yarrowia lipolytica* ATCC #20362 cells from a YPD agar plate were streaked onto a MM plate (75 mg/L each of uracil and uridine, 6.7 g/L YNB with ammonia sulfate, without amino acids, and 20 g/L glucose) containing 250 mg/L 5-FOA (Zymo Research, Orange, Calif.). Plates were incubated at 28° C. and four of the resulting colonies were patched separately onto MM plates containing 200 mg/mL 5-FOA and MM plates lacking uracil and uridine to confirm uracil Ura3 auxotrophy.

Generation of Strain Y4001 to Produce About 17% EDA of Total Lipids

Figure 13:
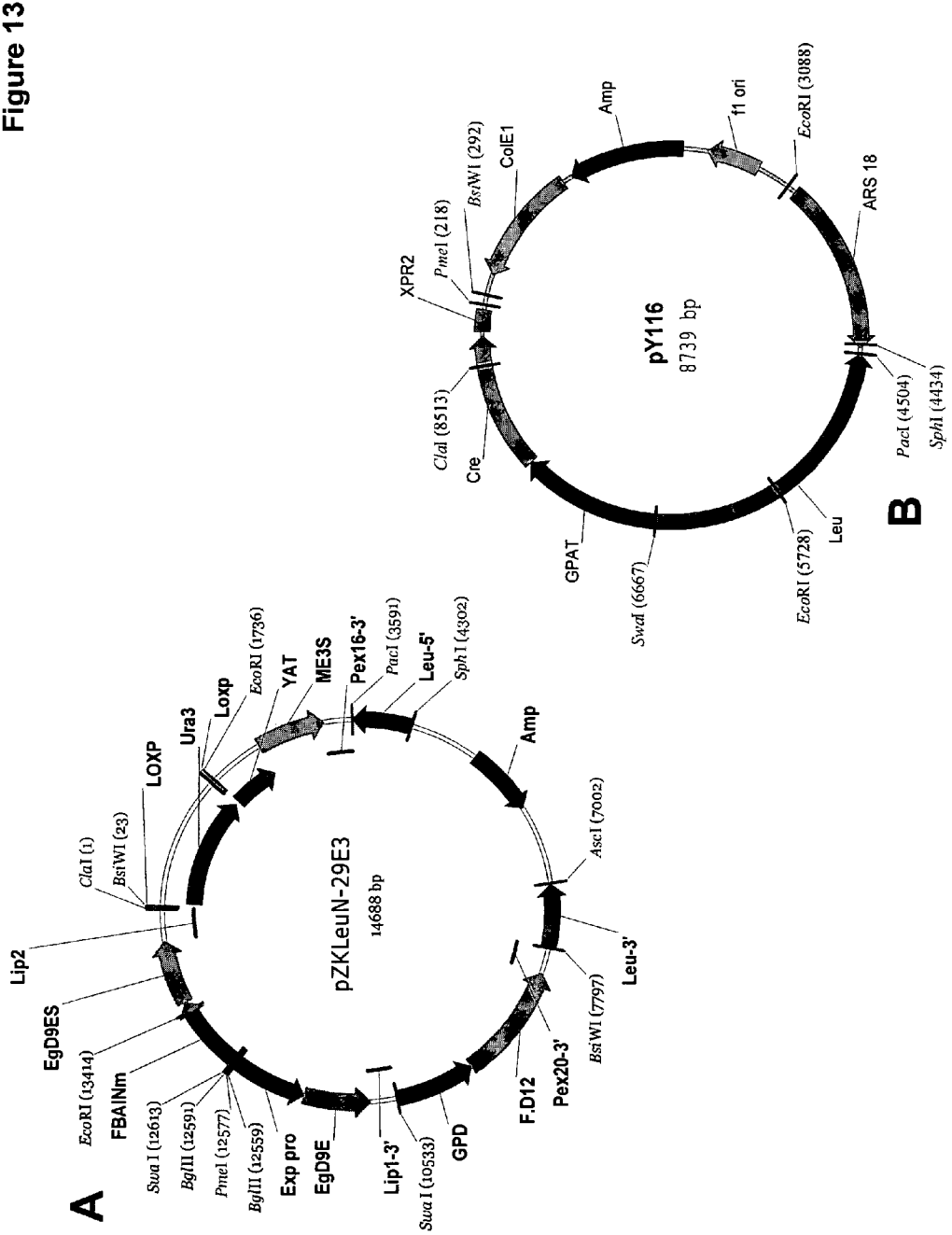
FIG. 13 provides plasmid maps for the following: (A) pZKLeuN-29E3; and, (B) pY116.

Strain Y4001 was created via integration of construct pZKLeuN-29E3 (FIG. 13A). This construct, comprising four chimeric genes (i.e., a Δ12 desaturase, a C$_{16/18}$ elongase and two Δ9 elongases), was integrated into the Leu2 loci of strain Y2224 to thereby enable production of EDA.

Construct pZKLeuN-29E3 contained the components shown below:

TABLE 15

Description of Plasmid pZKLeuN-29E3 (SEQ ID NO: 45)

| RE Sites And Nucleotides Within SEQ ID NO: 45 | Description Of Fragment And Chimeric Gene Components |
|---|---|
| BsiW I/Asc I (7797-7002) | 788 bp 3' portion of *Yarrowia* Leu2 gene (GenBank Accession No. AF260230) |
| Sph I/Pac I (4302-3591) | 703 bp 5' portion of *Yarrowia* Leu2 gene (GenBank Accession No. AF260230) |

TABLE 15-continued

Description of Plasmid pZKLeuN-29E3 (SEQ ID NO: 45)

| RE Sites And Nucleotides Within SEQ ID NO: 45 | Description Of Fragment And Chimeric Gene Components |
|---|---|
| Swa I/BsiW I (10533-7797) | GPD::FmD12::Pex20, comprising:<br>GPD: *Yarrowia lipolytica* GPD promoter (PCT Publication No. WO 2005/003310);<br>FmD12: *Fusarium moniliforme* Δ12 desaturase gene (SEQ ID NO: 46) (labeled as "F.D12" in Figure; PCT Publication No. WO 2005/047485);<br>Pex20: Pex20 terminator sequence from *Yarrowia* Pex20 gene (GenBank Accession No. AF054613) |
| Bgl II/Swa I (12559-10533) | EXP1::EgD9e::Lip1, comprising:<br>EXP1: *Yarrowia lipolytica* export protein (EXP1) promoter (labeled as "Exp pro" in Figure; PCT Publication No. WO 2006/052870 and U.S. Patent Application No. 11/265,761);<br>EgD9e: *Euglena gracilis* Δ9 elon ® gase (SEQ ID NO: 48) (labeled as "EgD9E" in Figure; PCT Publication No. WO 2007/061742);<br>Lip1: Lip1 terminator sequence from *Yarrowia* Lip1 gene (GenBank Accession No. Z50020) |
| Pme I/Cla I (12577-1) | FBAINm::EgD9eS::Lip2, comprising:<br>FBAINm: *Yarrowia lipolytica* FBAINm promoter (PCT Publication No. WO 2005/049805; U.S. Pat. No. 7,202,356);<br>EgD9eS: codon-optimized Δ9 elongase gene (SEQ ID NO: 50), derived from *Euglena gracilis* (labeled as "EgD9ES" in Figure; PCT Publication No. WO 2007/061742);<br>Lip2: Lip2 terminator sequence from *Yarrowia* Lip2 gene (GenBank Accession No. AJ012632) |
| Cla I/EcoR I (1-1736) | LoxP::Ura3::LoxP, comprising:<br>LoxP sequence (SEQ ID NO: 9);<br>*Yarrowia* Ura3 gene (GenBank Accession No. AJ306421);<br>LoxP sequence (SEQ ID NO: 9) |
| EcoR I/Pac I (1736-3591) | YAT1::ME3S::Pex16, comprising:<br>YAT1: *Yarrowia lipolytica* YAT1 promoter (labeled as "YAT" in Figure; Patent Publication No. U.S. 2006/0094102-A1);<br>ME3S: codon-optimized $C_{16/18}$ elongase gene (SEQ ID NO: 52), derived from *Mortierella alpine* (PCT Publication No. WO 2007/046817);<br>Pex16: Pex16 terminator sequence of *Yarrowia* Pex 16 gene (GenBank Accession No. U75433) |

Plasmid pZKLeuN-29E3 was digested with AscI/SphI, and then used for transformation of *Y. lipolytica* strain Y2224 (i.e., ATCC #20362 Ura3−) according to the General Methods. The transformant cells were plated onto MMLeu media plates and maintained at 30° C. for 2 to 3 days. The colonies were picked and streaked onto MM and MMLeu selection plates. The colonies that could grow on MMLeu plates but not on MM plates were selected as Leu− strains. Single colonies of Leu− strains were then inoculated into liquid MMLeu at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of EDA in the transformants containing the 4 chimeric genes of pZKLeuN-29E3, but not in the *Yarrowia* Y2224 control strain. Most of the selected 36 Leu− strains produced about 12 to 16.9% EDA of total lipids. There were 3 strains (i.e., strains #11, #30 and #34) that produced about 17.4%, 17% and 17.5% EDA of total lipids; they were designated as strains Y4001, Y4002 and Y4003, respectively.

Single colonies of Y4001, Y4002 and Y4003 strains were inoculated in liquid MMLeu at 30° C. and shaken at 250 rpm/min for 2 days. The cells were collected by centrifugation, resuspended in High Glucose Media and then shaken at 250 rpm/min for 5 days. The cells were collected by centrifugation, lipids were extracted, and fatty acid methyl esters were prepared by trans-esterification, and subsequently analyzed with a Hewlett-Packard 6890 GC. GC analyses showed that the Y4001, Y4002 and Y4003 strains produced about 24% EDA of total lipids.

Generation of Strain Y4001U (Leu−, Ura−)

Strain Y4001U was created via temporary expression of the Cre recombinase enzyme in plasmid pY116 (FIG. 13B) within strain Y4001 to produce a Leu− and Ura− phenotype. Construct pY116 contained the following components:

TABLE 16

Description of Plasmid pY116 (SEQ ID NO: 54)

| RE Sites And Nucleotides Within SEQ ID NO: 54 | Description Of Fragment And Chimeric Gene Components |
|---|---|
| 1328-448 | ColE1 plasmid origin of replication |
| 2258-1398 | Ampicillin-resistance gene ($Amp^R$) for selection in *E. coli* |
| 3157-4461 | *Yarrowia* autonomous replication sequence (ARS18; GenBank Accession No. A17608) |
| SwaI/PacI 6667-4504 | Yarrowia Leu2 gene (GenBank Accession No. AF260230) |
| Swa I/Pme I (6667-218) | GPAT::Cre::XPR2, comprising:<br>GPAT: *Yarrowia lipolytica* GPAT promoter (PCT Publication No. WO 2006/031937 and U.S. Pat. No. 7,264,949);<br>Cre: Enterobacteria phage P1 Cre gene for recombinase protein (GenBank Accession No. X03453);<br>XPR2: ~100 bp of the 3' region of the *Yarrowia* Xpr gene (GenBank Accession No. M17741) |

Plasmid pY116 was used for transformation of freshly grown Y4001 cells according to the General Methods. The transformant cells were plated onto MMLeuUra plates containing 280 μg/mL sulfonylurea (chlorimuron ethyl, E. I. duPont de Nemours & Co., Inc., Wilmington, Del.) and maintained at 30° C. for 3 to 4 days. Four colonies were picked, inoculated into 3 mL liquid YPD media at 30° C. and shaken at 250 rpm/min for 1 day. The cultures were diluted to 1:50,000 with liquid MMLeuUra media, and 100 μL was plated onto new YPD plates and maintained at 30° C. for 2 days. Colonies were picked and streaked onto MMLeu and MMLeuUra selection plates. The colonies that could grow on MMLeuUra plates but not on MMLeu plates were selected and analyzed by GC to confirm the presence of C20:2 (EDA). One strain, having a Leu− and Ura− phenotype, produced about 17% EDA of total lipids and was designated as Y4001U.

Generation of Strain Y4036 to Produce About 18% DGLA of Total Lipids

Figure 14:
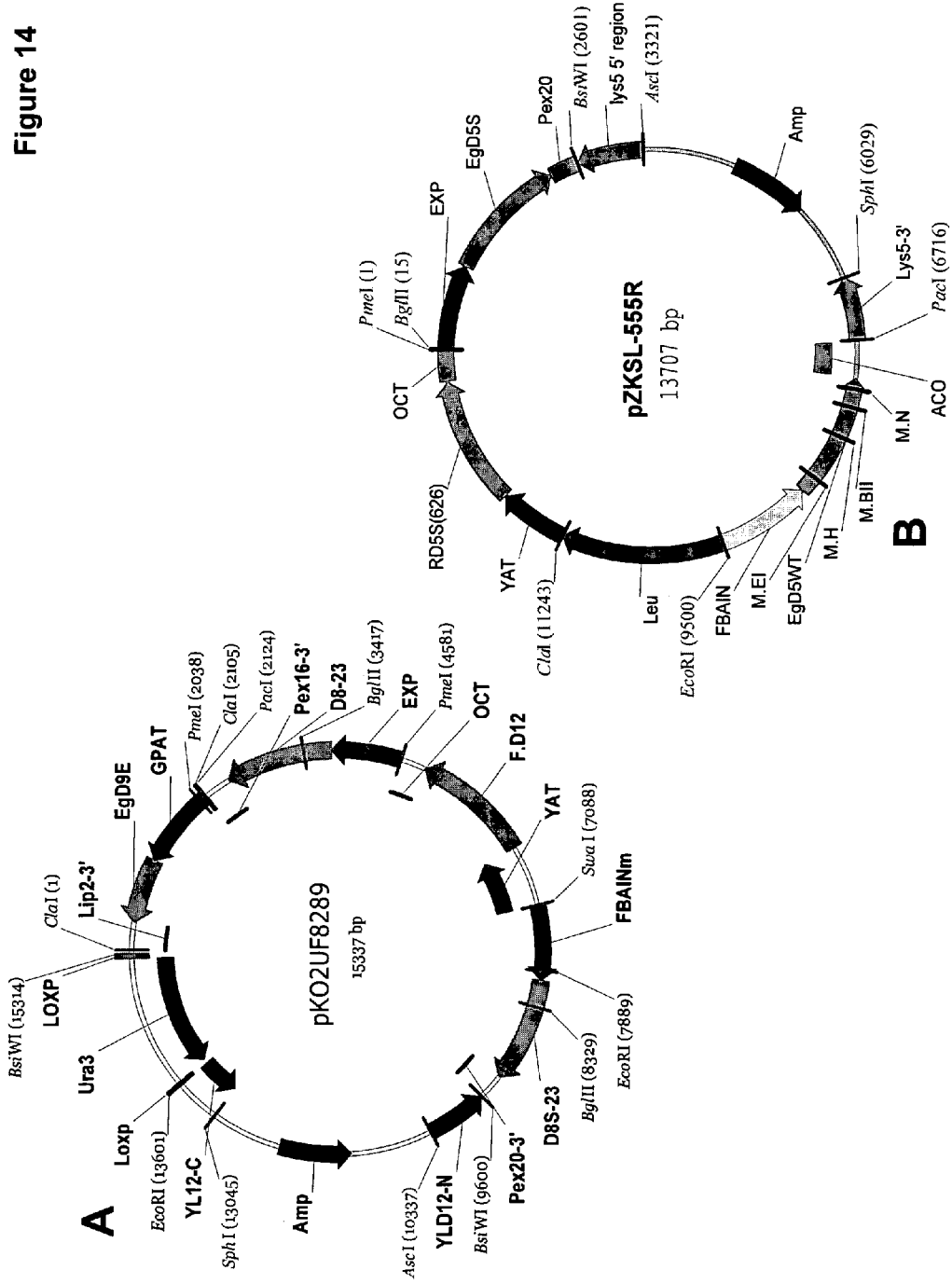
FIG. 14 provides plasmid maps for the following: (A) pKO2UF8289; and, (B) pZKSL-555R.

Construct pKO2UF8289 (FIG. 14A; SEQ ID NO:55) was generated to integrate four chimeric genes (comprising a Δ12 desaturase, one Δ9 elongase and two mutant Δ8 desaturases) into the Δ12 loci of strain Y4001U1, to thereby enable production of DGLA. Construct pKO2UF8289 contained the following components:

TABLE 17

Description of Plasmid pKO2UF8289 (SEQ ID NO: 55)

| RE Sites And Nucleotides Within SEQ ID NO: 55 | Description Of Fragment And Chimeric Gene Components |
|---|---|
| AscI/BsiWI (10337-9600) | 5' portion of *Yarrowia* Δ12 desaturase gene (SEQ ID NO: 56) (labeled as "YLD12-N" in Figure; PCT Publication No. WO 2004/104167; U.S. Pat. No. 7,214,491) |
| EcoRI/SphI (13601-13045) | 3' portion of *Yarrowia* Δ12 desaturase gene (SEQ ID NO: 56) (labeled as "YL12-C" in Figure; PCT Publication No. WO 2004/104167; U.S. Pat. No. 7,214,491) |
| SwaI/BsiWI (7088-9600) | FBAINm::EgD8M::Pex20, comprising:<br>FBAINm: *Yarrowia lipolytica* FBAINm promoter (PCT Publication No. WO 2005/049805; U.S. Pat. No. 7,202,356);<br>EgD8M: Synthetic mutant Δ8 desaturase (SEQ ID NO: 58) (labeled as "D8S-23" in Figure; U.S. Patent Application No. 11/635,258), derived from *Euglena gracilis* ("EgD8S"; PCT Publication No. WO 2006/012326);<br>Pex20: Pex20 terminator sequence from *Yarrowia* Pex20 gene (GenBank Accession No. AF054613) |
| SwaI/PmeI (7088-4581) | YAT1::FmD12::OCT, comprising:<br>YAT1: *Yarrowia lipolytica* YAT1 promoter (labeled as "YAT" in Figure; Patent Publication No. US 2006/0094102-A1);<br>FmD12: *Fusarium moniliforme* Δ12 desaturase gene (SEQ ID NO: 46) (labeled as "F.D12" in Figure; PCT Publication No. WO 2005/047485);<br>OCT: OCT terminator sequence of *Yarrowia* OCT gene (GenBank Accession No. X69988) |
| PmeI/PacI (4581-2124) | EXP1::EgD8M::Pex16, comprising:<br>EXP1: *Yarrowia lipolytica* export protein (EXP1) promoter (PCT Publication No. WO 2006/052870 and U.S. Patent Application No. 11/265,761);<br>EgD8M: Synthetic mutant Δ8 desaturase (SEQ ID NO: 58) (labeled as "D8-23" in Figure; U.S. Patent Application No. 11/635,258), derived from *Euglena gracilis* ("EgD8S"; PCT Publication No. WO 2006/012326);<br>Pex16: Pex16 terminator sequence from *Yarrowia* Pex16 gene (GenBank Accession No. U75433) |
| PmeI/ClaI (2038-1) | GPAT::EgD9e::Lip2, comprising:<br>GPAT: *Yarrowia lipolytica* GPAT promoter (PCT Publication No. WO 2006/031937 and U.S. Pat. No. 7,264,949);<br>EgD9e: *Euglena gracilis* Δ9 elongase gene (SEQ ID NO: 48) (labeled as "EgD9E" in Figure; PCT Publication No. WO 2007/061742);<br>Lip2: Lip2 terminator sequence from *Yarrowia* Lip2 gene (GenBank Accession No. AJ012632) |
| ClaI/EcoRI (13601-1) | LoxP::Ura3::LoxP, comprising:<br>LoxP sequence (SEQ ID NO: 9);<br>*Yarrowia* Ura3 gene (GenBank Accession No. AJ306421);<br>LoxP sequence (SEQ ID NO: 9) |

The pKO2UF8289 plasmid was digested with AscI/SphI, and then used for transformation of strain Y4001U1 according to the General Methods. The transformant cells were plated onto MMLeu plates and maintained at 30° C. for 2 to 3 days. The colonies were picked and streaked onto MMLeu selection plates at 30° C. for 2 days. These cells were then inoculated into liquid MMLeu at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of DGLA in the transformants containing the 4 chimeric genes of pKO2UF8289, but not in the parent Y4001U1 strain. Most of the selected 96 strains produced between 7% and 13% DGLA of total lipids. There were 6 strains (i.e., #32, #42, #60, #68, #72 and #94) that produced about 15%, 13.8%, 18.2%, 13.1%, 15.6% and 13.9% DGLA of total lipids. These six strains were designated as Y4034, Y4035, Y4036, Y4037, Y4038 and Y4039, respectively.

Generation of Strain Y4036U (Leu−, Ura3−)

Construct pY116 (FIG. 13B; SEQ ID NO:54 was utilized to temporarily express a Cre recombinase enzyme in strain Y4036. This released the LoxP sandwiched Ura3 gene from the genome.

Plasmid pY116 was used to transform strain Y4036 according to the General Methods. Following transformation, the cells were plated onto MMLeuUra plates and maintained at 30° C. for 2 to 3 days. The individual colonies grown on MMLeuUra plates were picked, and streaked into YPD liquid media at 30° C. and shaken at 250 rpm/min for 1 day to cure the pY116 plasmid. The grown cultures were streaked on MMLeuUra plates. After two days at 30° C., the individual colonies were re-streaked on MMLeuUra, MMU and MMLeu plates. Those colonies that could grow on MMLeuUra, but not on MMU or MMLeu plates were selected. One of these strains with Leu− and Ura− phenotypes was designated as Y4036U (Ura−, Leu−).

Generation of Strain Y4069 to Produce About 12% ARA of Total Lipids

Construct pZKSL-555R (FIG. 14B; SEQ ID NO:62) was generated to integrate three Δ5 desaturase genes into the Lys loci of strain Y4036U, to thereby enable production of ARA. The pZKSL-555R plasmid contained the following components:

TABLE 18

Description of Plasmid pZKSL-555R (SEQ ID NO: 62)

| RE Sites And Nucleotides Within SEQ ID NO: 62 | Description Of Fragment And Chimeric Gene Components |
|---|---|
| AscI/BsiWI (3321-2601) | 720 bp 5' portion of *Yarrowia* Lys5 gene (GenBank Accession No. M34929) |
| PacI/SphI (6716-6029) | 687 bp 3' portion of *Yarrowia* Lys5 gene (GenBank Accession No. M34929) |
| BglII/BsiWI (15-2601) | EXP1::EgD5S::Pex20, comprising:<br>EXP1: *Yarrowia lipolytica* export protein (EXP1) promoter (labeled as "EXP" in Figure; PCT Publication No. WO 2006/052870 and U.S. Patent Application No. 11/265,761);<br>EgD5S: codon-optimized Δ5 desaturase (SEQ ID NO: 63), derived from *Euglena gracilis* (U.S. Patent Application No. 11/748,629);<br>Pex20: Pex20 terminator sequence from *Yarrowia* Pex20 gene (GenBank Accession No. AF054613) |
| ClaI/PmeI (11243-1) | YAT1::RD5S::OCT, comprising:<br>YAT1: *Yarrowia lipolytica* YAT1 promoter (labeled as "YAT" in Figure; Patent Publication US 2006/0094102-A1);<br>RD5S: codon-optimized Δ5 desaturase (SEQ ID NO: 65), derived from *Peridinium* sp. CCMP626 (labeled as "RD5S(626)" in Figure; U.S. Patent Application No. 11/748,637);<br>OCT: OCT terminator sequence of *Yarrowia* OCT gene (GenBank Accession No. X69988) |
| EcoRI/PacI (9500-6716) | FBAIN::EgD5::Aco, comprising:<br>FBAIN: *Yarrowia lipolytica* FBAIN promoter (PCT Publication No. WO 2005/049805; U.S. Pat. No. 7,202,356);<br>EgD5: *Euglena gracilis* Δ5 desaturase (SEQ ID NO: 67) (labeled as "EgD5WT" in Figure; U.S. Patent |

TABLE 18-continued

Description of Plasmid pZKSL-555R (SEQ ID NO: 62)

| RE Sites And Nucleotides Within SEQ ID NO: 62 | Description Of Fragment And Chimeric Gene Components |
|---|---|
| | Application No. 11/748,629) with elimination of internal EcoRI, BglII, HindIII and NcoI restriction enzyme sites [mutations labeled as "M.EI", "M.BII", "M.H" and "M.N", respectively]; Aco: Aco terminator sequence from *Yarrowia* Aco gene (GenBank Accession No. AJ001300) |
| EcoRI/ClaI (9500-11243) | *Yarrowia* Leu2 gene (GenBank Accession No. M37309) |

The pZKSL-555R plasmid was digested with AscI/SphI, and then used for transformation of strain Y4036U according to the General Methods. The transformant cells were plated onto MMLeuLys plates and maintained at 30° C. for 2 to 3 days. Single colonies were then re-streaked onto MMLeuLys plates, and then inoculated into liquid MMLeuLys at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of ARA in the transformants containing the 3 chimeric genes of pZKSL-555R, but not in the parent Y4036U strain. Most of the selected 96 strains produced ~10% ARA of total lipids. There were 4 strains (i.e., #57, #58, #69 and #75) that produced about 11.7%, 11.8%, 11.9% and 11.7% ARA of total lipids. These four strains were designated as Y4068, Y4069, Y4070 and Y4071, respectively. Further analyses showed that the three chimeric genes of pZKSL-555R were not integrated into the Lys5 site in the Y4068, Y4069, Y4070 and Y4071 strains. All strains possessed a Lys+ phenotype.

Generation of Strain Y4084 to Produce About 14% EPA of Total Lipids

Figure 15:
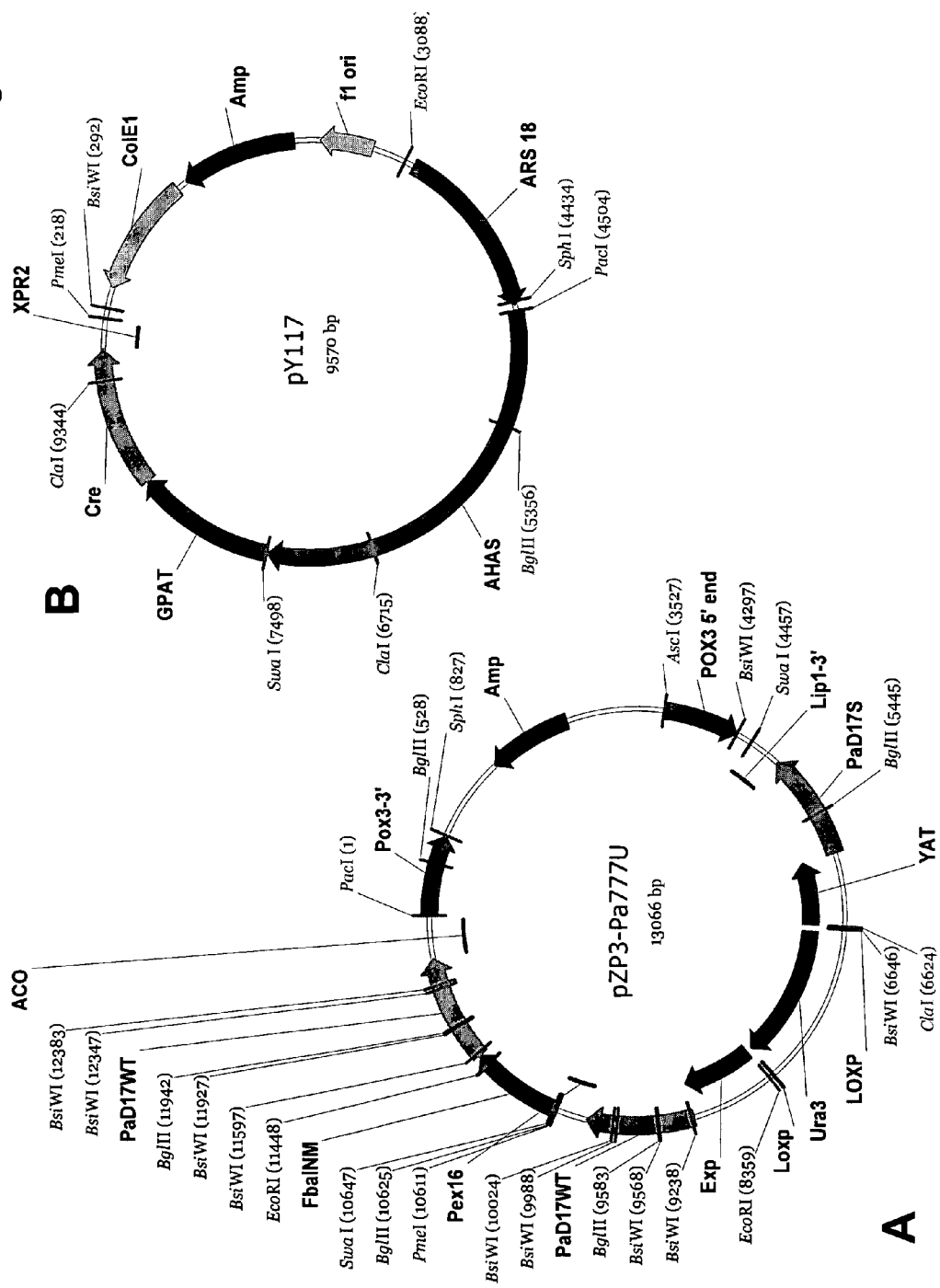
FIG. 15 provides plasmid maps for the following: (A) pZP3-Pa777U; and, (B) pY117.

Construct pZP3-Pa777U (FIG. 15A; SEQ ID NO:69) was generated to integrate three Δ17 desaturase genes into the Pox3 loci (GenBank Accession No. AJ∆01301) of strain Y4069, to thereby enable production of EPA. The pZP3-Pa777U plasmid contained the following components:

TABLE 19

Description of Plasmid pZP3-Pa777U (SEQ ID NO: 69)

| RE Sites And Nucleotides Within SEQ ID NO: 69 | Description Of Fragment And Chimeric Gene Components |
|---|---|
| AscI/BsiWI (3527-4297) | 770 bp 5' portion of *Yarrowia* Pox3 gene (GenBank Accession No. AJ001301) |
| PacI/SphI (1-827) | 827 bp 3' portion of *Yarrowia* Pox3 gene (GenBank Accession No. AJ001301) |
| ClaI/SwaWI (6624-4457) | YAT1::PaD17S::Lip1, comprising: YAT1: *Yarrowia lipolytica* YAT1 promoter (labeled as "YAT" in Figure; Patent Publication US 2006/0094102-A1); PaD17S: codon-optimized Δ17 desaturase (SEQ ID NO: 70), derived from *Pythium aphanidermatum* (U.S. Patent Application No. 11/779,915); Lip1: Lip1 terminator sequence from *Yarrowia* Lip1 gene (GenBank Accession No. Z50020) |

TABLE 19-continued

Description of Plasmid pZP3-Pa777U (SEQ ID NO: 69)

| RE Sites And Nucleotides Within SEQ ID NO: 69 | Description Of Fragment And Chimeric Gene Components |
|---|---|
| EcoRI/PmeI (8359-10611) | EXP1::PaD17::Pex16, comprising: EXP1: *Yarrowia lipolytica* export protein (EXP1) promoter (labeled as "Exp" in Figure; PCT Publication No. WO 2006/052870 and U.S. Patent Application No. 11/265,761); PaD17: *Pythium aphanidermatum* Δ17 desaturase gene (SEQ ID NO: 72) (labeled as "PaD17WT" in Figure; U.S. Patent Application No. 11/779,915); Pex16: Pex16 terminator sequence from *Yarrowia* Pex16 gene (GenBank Accession No. U75433) |
| PmeI/PacI (10611-1) | FBAINm::PaD17::Aco, comprising: FBAINm: *Yarrowia lipolytica* FBAINm promoter (PCT Publication No. WO 2005/049805; U.S. Pat. No. 7,202,356); PaD17: *Pythium aphanidermatum* Δ17 desaturase gene (SEQ ID NO: 72) (labeled as "PaD17WT" in Figure; U.S. Patent Application No. 11/779,915); Aco: Aco terminator sequence from *Yarrowia* Aco gene (GenBank Accession No. AJ001300) |
| ClaI/EcoRI (6624-8359) | LoxP::Ura3::LoxP, comprising: LoxP sequence (SEQ ID NO: 9); *Yarrowia* Ura3 gene (GenBank Accession No. AJ306421); LoxP sequence (SEQ ID NO: 9) |

The pZP3-Pa777U plasmid was digested with AscI/SphI, and then used for transformation of strain Y4069 according to the General Methods. The transformant cells were plated onto MM plates and maintained at 30° C. for 2 to 3 days. Single colonies were then re-streaked onto MM plates, and inoculated into liquid MMLeuLys at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of EPA in the transformants containing the 3 chimeric genes of pZP3-Pa777U, but not in the parent Y4069 strain. Most of the selected 96 strains produced 10-13.5% EPA of total lipids. There was one strain (i.e., #83) that produced about 13.7% EPA of total lipids. This strain was designated as Y4084.

The final genotype of strain Y4084 with respect to wildtype *Yarrowia lipolytica* ATCC #20362 was Ura3+, Leu+, Lys+, unknown 1–, unknown 2–, unknown 3–, GPD::FmD12::Pex20, YAT1::FmD12::OCT, YAT1::ME3S::Pex16, GPAT::EgD9e::Lip2, EXP1::EgD9eS::Lip1, FBAINm::EgD9eS::Lip2, FBAINm::EgD8M::Pex20, EXP1::EgD8M::Pex16, FBAIN::EgD5::Aco, EXP1::EgD5S::Pex20, YAT1::RD5S::OCT, YAT1::PaD17S::Lip1, EXP1::PaD17::Pex16, FBAINm::PaD17::Aco.

Generation of Y4084U1 Strain (Ura3–)

Strain Y4084U1 was created via temporary expression of the Cre recombinase enzyme in construct pY117 (FIG. 15B; SEQ ID NO:74) within strain Y4084 to produce a Ura– phenotype. This released the LoxP sandwiched Ura3 gene from the genome. The mutated *Yarrowia* AHAS enzyme (SEQ ID NO:1) in plasmid pY117 conferred $SU^R$, which was used as a positive screening marker.

Plasmid pY117 was derived from plasmid pY116 (supra, and in U.S. patent application Ser. No. 11/635,258) by inserting the mutant AHAS gene flanked by PacI-SwaI sites into PacI-SwaI digested pY116, thereby replacing the LEU selectable marker with the sulfonylurea marker. Construct pY117 thereby contained the following components:

TABLE 20

Description of Plasmid pY117 (SEQ ID NO: 74)

| RE Sites And Nucleotides Within SEQ ID NO: 74 | Description Of Fragment And Chimeric Gene Components |
|---|---|
| 1328-448 | ColE1 plasmid origin of replication |
| 2258-1398 | Ampicillin-resistance gene (Amp$^R$) for selection in E. coli |
| 2438-2838 | E. coli f1 origin of replication |
| 3157-4461 | Yarrowia autonomous replication sequence (ARS18; GenBank Accession No. A17608) |
| PacI/SwaI 4504-7498 | Yarrowia lipolytica AHAS gene (GenBank Accession No. XP_501277) comprising a W497L mutation (SEQ ID NO: 1; P Publication No. WO 2006/052870) |
| SwaI/PmeI 7498-218 | GPAT::Cre::XPR, comprising: GPAT: Yarrowia lipolytica GPAT promoter (PCT Publication No. WO 2006/031937 and U.S. Pat. No. 7,264,949); Cre: Enterobacteria phage P1 Cre gene for recombinase protein (GenBank Accession No. X03453) except for single base change (T4G) resulting in a single amino acid change (S2A) to create a NcoI site for cloning convenience; XPR: ~100 bp of the 3' region of the Yarrowia Xpr gene (GenBank Accession No. M17741) |

Plasmid pY117 was used to transform strain Y4084 according to the General Methods. Following transformation, the cells were plated onto MMU+SU (280 μg/mL sulfonylurea; also known as chlorimuron ethyl, E. I. duPont de Nemours & Co., Inc., Wilmington, Del.) plates and maintained at 30° C. for 2 to 3 days. The individual SU$^R$ colonies grown on MMU+SU plates were picked, and streaked into YPD liquid media at 30° C. and shaken at 250 rpm/min for 1 day to cure the pY117 plasmid. The grown cultures were streaked onto MMU plates. After two days at 30° C., the individual colonies were re-streaked onto MM and MMU plates. Those colonies that could grow on MMU, but not on MM plates were selected. Two of these strains with Ura− phenotypes were designated as Y4084U1 and Y4084U2 (Ura−).

Generation of Strain Y4127 to Produce About 18% EPA of Total Lipids

Figure 16:
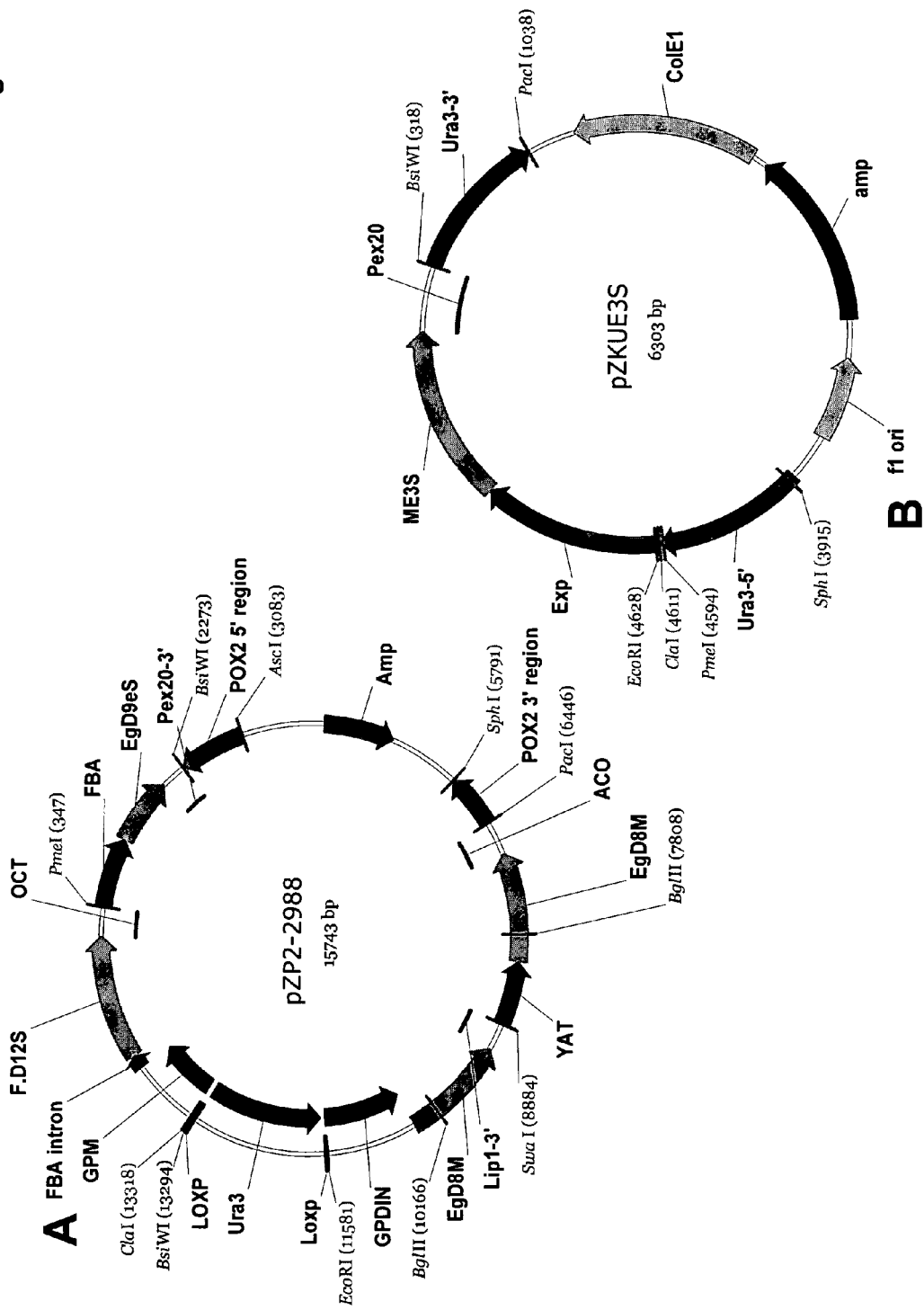
FIG. 16 provides plasmid maps for the following: (A) pZP2-2988; and, (B) pZKUE3S.

Construct pZP2-2988 (FIG. 16A; SEQ ID NO:75) was generated to integrate one Δ12 desaturase gene, two Δ8 desaturase genes and one Δ9 elongase gene into the Pox2 loci (GenBank Accession No. AJ001300) of strain Y4084U1, to thereby enable higher level production of EPA. The pZP2-2988 plasmid contained the following components:

TABLE 21

Description of Plasmid pZP2-2988 (SEQ ID NO: 75)

| RE Sites And Nucleotides Within SEQ ID NO: 75 | Description Of Fragment And Chimeric Gene Components |
|---|---|
| AscI/BsiWI (3083-2273) | 803 bp 5' portion of Yarrowia Pox2 gene (GenBank Accession No. AJ001300) |
| PacI/SphI (6446-5791) | 649 bp 3' portion of Yarrowia Pox2 gene (GenBank Accession No. AJ001300) |
| PmeI/BsiWI (347-2273) | FBA::EgD9eS::Pex20, comprising: FBA: Yarrowia lipolytica FBA promoter (PCT Publication No. WO 2005/049805; U.S. Pat. No. 7,202,356); |

TABLE 21-continued

Description of Plasmid pZP2-2988 (SEQ ID NO: 75)

| RE Sites And Nucleotides Within SEQ ID NO: 75 | Description Of Fragment And Chimeric Gene Components |
|---|---|
| | EgD9eS: codon-optimized Δ9 elongase (SEQ ID NO: 50), derived from Euglena gracilis (PCT Publication No. WO 2007/061742); Pex20: Pex20 terminator sequence from Yarrowia Pex20 gene (GenBank Accession No. AF054613) |
| ClaI/PmeI (13318-347) | GPM/FBAIN::FmD12S::OCT, comprising: GPM/FBAIN: chimeric Yarrowia lipolytica GPM/FBAIN promoter (separately labeled as "GPM" and "FBA intron" in Figure) (PCT Publication No. WO 2005/049805; U.S. Pat. No. 7,202,356); FmD12S: codon-optimized Δ12 desaturase (SEQ ID NO: 76), derived from Fusarium moniliforme (labeled as "F.D12S" in Figure; PCT Publication No. WO 2005/047485); OCT: OCT terminator sequence of Yarrowia OCT gene (GenBank Accession No. X69988) |
| ClaI/EcoRI (13318-11581) | LoxP::Ura3::LoxP, comprising: LoxP sequence (SEQ ID NO: 9); Yarrowia Ura3 gene (GenBank Accession No. AJ306421); LoxP sequence (SEQ ID NO: 9) |
| EcoRII/SwaI (11581-8884) | GPDIN::EgD8M::Lip1, comprising: GPDIN: Yarrowia lipolytica GPDIN promoter (Patent Publication US 2006/0019297-A1); EgD8M: Synthetic mutant Δ8 desaturase (SEQ ID NO: 58; U.S. Patent Application No. 11/635,258), derived from Euglena gracilis ("EgD8S"; PCT Publication No. WO 2006/012326); Lip1: Lip1 terminator sequence from Yarrowia Lip1 gene (GenBank Accession No. Z50020) |
| SwaI/PacI (8884-6446) | YAT1::EgD8M::ACO, comprising: YAT1: Yarrowia lipolytica YAT1 promoter (labeled as "YAT" in Figure; Patent Publication US 2006/0094102-A1); EgD8M: Synthetic mutant Δ8 desaturase (SEQ ID NO: 58; U.S. Patent Application No. 11/635,258), derived from Euglena gracilis ("EgD8S"; PCT Publication No. WO 2006/012326); Aco: Aco terminator sequence from Yarrowia Aco gene (GenBank Accession No. AJ001300) |

The pZP2-2988 plasmid was digested with AscI/SphI, and then used for transformation of strain Y4084U1 according to the General Methods. The transformant cells were plated onto MM plates and maintained at 30° C. for 2 to 3 days. Single colonies were re-streaked onto MM plates, and then inoculated into liquid MMLeuLys at 30° C. and shaken at 250 rpm/min for 2 days. The cells were collected by centrifugation, resuspended in High Glucose Media and then shaken at 250 rpm/min for 5 days. The cells were collected by centrifugation, lipids were extracted, and fatty acid methyl esters were prepared by trans-esterification, and subsequently analyzed with a Hewlett-Packard 6890 GC.

GC analyses showed that most of the selected 96 strains produced 12-16.4% EPA of total lipids. There were 6 strains (i.e., #5, #12, #15, #17, #74 and #80) that produced about 16.6%, 16.9%, 17%, 16.7% 16.5% and 18.1% EPA of total lipids. These six strains were designated as Y4122, Y4123, Y4124, Y4125, Y4126 and Y4127, respectively.

The final genotype of strain Y4127 with respect to wildtype Yarrowia lipolytica ATCC #20362 was: unknown 1−, unknown 2−, unknown 3−, unknown 4−, GPD::FmD12:: Pex20, YAT1::FmD12::OCT, GPM/FBAIN::FmD12S::OCT, YAT1::ME3S::Pex16, GPAT::EgD9e::Lip2, EXP1::EgD9e:: Lip1, FBAINm::EgD9eS::Lip2, FBA::EgD9eS::Pex20, FBAINm::EgD8M::Pex20, EXP1::EgD8M::Pex16, GPDIN::EgD8M::Lip1, YAT1::EgD8M::Aco, FBAIN::

EgD5::Aco, EXP1::EgD5S::Pex20, YAT1::RD5S::OCT, YAT1::PaD17S::Lip1, EXP1::PaD17::Pex16, FBAINm::PaD17::Aco.

Generation of Strain Y4127U2 (Ura3–)

In order to disrupt the Ura3 gene in strain Y4127, construct pZKUE3S (FIG. 16B; SEQ ID NO:78) was created to integrate a EXP1::ME3S::Pex20 chimeric gene into the Ura3 gene of strain Y4127. Plasmid pZKUE3S contained the following components:

TABLE 22

Description of Plasmid pZKUE3S (SEQ ID NO: 78)

| RE Sites And Nucleotides Within SEQ ID NO: 78 | Description Of Fragment And Chimeric Gene Components |
|---|---|
| BsiWI/PacI (318-1038) | 721 bp 5' portion of Yarrowia Ura3 gene (GenBank Accession No. AJ306421) |
| SphI/PmeI (3915-4594) | 729 bp 3' portion of Yarrowia Ura3 gene (GenBank Accession No. AJ306421) |
| EcoRI/BsiWI (4628-318) | EXP1::ME3S::Pex20, comprising: EXP1: Yarrowia lipolytica export protein (EXP1) promoter (labeled as "Exp" in FIGURE; PCT Publication No. WO 2006/052870 and U.S. Patent Application No. 11/265,761); ME3S: codon-optimized $C_{16/18}$ elongase gene (SEQ ID NO: 52), derived from Mortierella alpina (PCT Publication No. WO 2007/046817); Pex20: Pex20 terminator sequence of Yarrowia Pex20 gene (GenBank Accession No. AF054613) |
| 2149-1269 | ColE1 plasmid origin of replication |
| 3079-2219 | Ampicillin-resistance gene ($Amp^R$) for selection in E. coli |
| 3659-3259 | E. coli f1 origin of replication |

Plasmid pZKUE3S was digested with SphI/PacI, and then used to transform strain Y4127 according to the General Methods. Following transformation, cells were plated onto MM+5-FOA selection plates and maintained at 30° C. for 2 to 3 days.

Two transformants grown on MM+5-FOA selection plates were picked and re-streaked onto fresh MM+5-FOA plates. The cells were stripped from the plates, lipids were extracted, and fatty acid methyl esters were prepared by trans-esterification, and subsequently analyzed with a Hewlett-Packard 6890 GC.

GC analyses showed that there were about 10.4% and 11.3% EPA of total lipids in these two transformants with pZKUE3S from plates. These two strains were designated as Y4127U1 and Y4127U2.

Generation of Strain Y4158 to Produce About 25% EPA of Total Lipids

Figure 17:
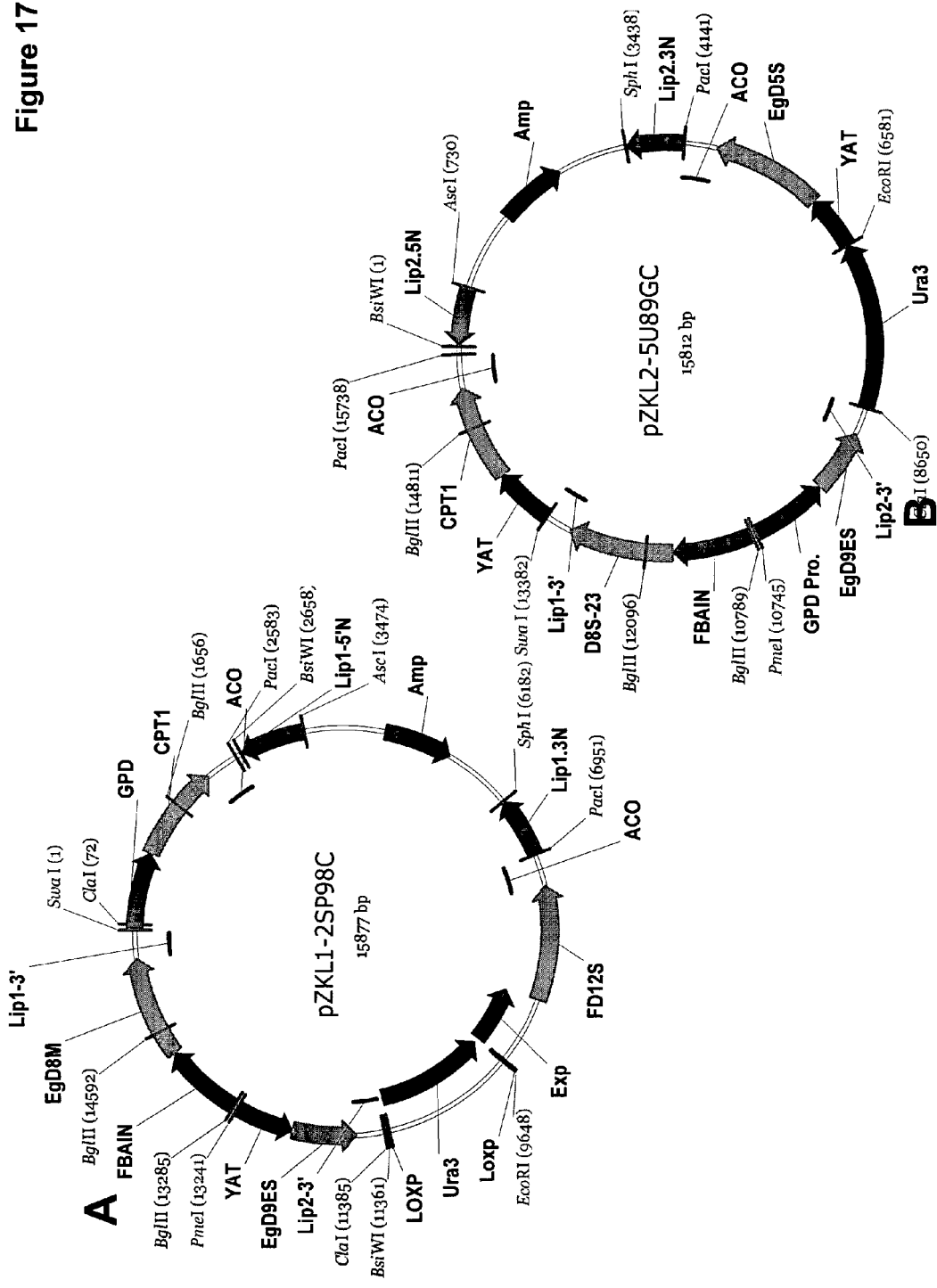
FIG. 17 provides plasmid maps for the following: (A) pZKL1-2SP98C; and, (B) pZKL2-5U89GC.

Construct pZKL1-2SP98C (FIG. 17A; SEQ ID NO:79) was generated to integrate one Δ9 elongase gene, one Δ8 desaturase gene, one Δ12 desaturase gene and one Yarrowia lipolytica diacylglycerol cholinephosphotransferase (CPT1) gene into the Lip1 loci (GenBank Accession No. Z50020) of strain Y4127U2, thereby resulting in isolation of strain Y4158 (producing 25% EPA). The pZKL1-2SP98C plasmid contained the following components:

TABLE 23

Description of Plasmid pZKL1-2SP98C (SEQ ID NO: 79)

| RE Sites And Nucleotides Within SEQ ID NO: 79 | Description Of Fragment And Chimeric Gene Components |
|---|---|
| AscI/BsiWI (3474-2658) | 809 bp 5' portion of Yarrowia Lip1 gene (labeled as "Lip1-5'N" in Figure; GenBank Accession No. Z50020) |
| PacI/SphI (6951-6182) | 763 bp 3' portion of Yarrowia Lip1 gene (labeled as "Lip1.3N" in Figure; GenBank Accession No. Z50020) |
| SwaI/BsiWI (1-2658) | GPD::YICPT1::Aco, comprising: GPD: Yarrowia lipolytica GPD promoter (PCT Publication No. WO 2005/003310); YICPT1: Yarrowia lipolytica diacylglycerol cholinephosphotransferase gene (SEQ ID NO: 80) (labeled as "CPT1" in Figure; PCT Publication No. WO 2006/052870); Aco: Aco terminator sequence from Yarrowia Aco gene (GenBank Accession No. AJ001300) |
| PmeI/SwaI (13241-1) | FBAIN::EgD8M::Lip1 comprising: FBAIN: Yarrowia lipolytica FBAIN promoter (PCT Publication No. WO 2005/049805; U.S. Pat. No. 7,202,356); EgD8M: Synthetic mutant Δ8 desaturase (SEQ ID NO: 58; U.S. Patent Application No. 11/635,258), derived from Euglena gracilis ("EgD8S"; PCT Publication No. WO 2006/012326); Lip1: Lip1 terminator sequence from Yarrowia Lip1 gene (GenBank Accession No. Z50020) |
| PmeI/ClaI (13241-11385) | YAT1::EgD9eS::Lip2, comprising: YAT1: Yarrowia lipolytica YAT1 promoter (labeled as "YAT" in Figure; Patent Publication US 2006/0094102-A1); EgD9eS: codon-optimized Δ9 elongase gene (SEQ ID NO: 50), derived from Euglena gracilis (labeled as "EgD9ES" in Figure; PCT Publication No. WO 2007/061742); Lip2: Lip2 terminator sequence from Yarrowia Lip2 gene (GenBank Accession No. AJ012632) |
| ClaI/EcoRI (11385-9648) | LoxP::Ura3::LoxP, comprising: LoxP sequence (SEQ ID NO: 9); Yarrowia Ura3 gene (GenBank Accession No. AJ306421); LoxP sequence (SEQ ID NO: 9) |
| EcoRI/PacI (9648-6951) | EXP1::FmD12S::ACO, comprising: EXP1: Yarrowia lipolytica export protein (EXP1) promoter (labeled as "Exp" in Figure; PCT Publication No. WO 2006/052870 and U.S. Patent Application No. 11/265,761); FmD12S: codon-optimized Δ12 elongase (SEQ ID NO: 76), derived from Fusarium moniliforme (labeled as "FD12S" in Figure; PCT Publication No. WO 2005/047485); Aco: Aco terminator sequence from Yarrowia Aco gene (GenBank Accession No. AJ001300) |

The pZKL1-2SP98C plasmid was digested with AscI/SphI, and then used for transformation of strain Y4127U2 according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in High Glucose Media and then shaken at 250 rpm/min for 5 days. The cells were collected by centrifugation, lipids were extracted, and fatty acid methyl esters were prepared by trans-esterification, and subsequently analyzed with a Hewlett-Packard 6890 GC.

GC analyses showed that most of the selected 96 strains produced 18-23.9% EPA of total lipids. There were 11 strains (i.e., #23, #61, #63, #67, #68, #73, #75, #85, #90, #91 and #95) that produced about 25.2%, 24.2%, 24%, 24.2%, 24%, 24%, 24.4%, 24.3%, 24.6%, 24.4% and 25.4% EPA of total lipids. These eleven strains were designated as Y4148, Y4149, Y4150, Y4151, Y4152, Y4153, Y4154, Y4155, Y4156, Y4157 and Y4158, respectively.

The final genotype of strain Y4158 with respect to wildtype *Yarrowia lipolytica* ATCC #20362 was: unknown 1–, unknown 2–, unknown 3–, unknown 4–, unknown 5–, GPD::FmD12::Pex20, YAT1::FmD12::OCT, GPM/FBAIN::FmD12S::OCT, EXP1::FmD12S::ACO, EXP1::ME3S::Pex20, YAT1::ME3S::Pex16, GPAT::EgD9e::Lip2, EXP1::EgD9e::Lip1, FBAINm::EgD9eS::Lip2, FBA::EgD9eS::Pex20, YAT1::EgD9eS::Lip2, FBAIN::EgD8M::Lip1, FBAINm::EgD8M::Pex20, EXP1::EgD8M::Pex16, GPDIN::EgD8M::Lip1, YAT1::EgD8M::Aco, FBAIN::EgD5::Aco, EXP1::EgD5S::Pex20, YAT1::RD5S::OCT, YAT1::PaD17S::Lip1, EXP1::PaD17::Pex16, FBAINm::PaD17::Aco, GPD::YICPT1::Aco.

Generation of Strain Y4158U1 (Ura3–)

A Ura– derivative (i.e., strain Y4158U1) was then created, via transformation with construct pZKUE3S (FIG. 16B; SEQ ID NO:78), comprising a chimeric EXP1::ME3S::Pex20 gene targeted for the Ura3 gene. Following transformation, cells were plated onto MM+5-FOA selection plates and maintained at 30° C. for 3 to 4 days.

A total of 6 transformants grown on MM+5-FOA plates were picked and re-streaked onto MM plates and MM+5-FOA plates, separately. All 6 strains had a Ura– phenotype (i.e., cells could grow on MM+5-FOA plates, but not on MM plates). The cells were scraped from the MM+5-FOA plates, lipids were extracted, and fatty acid methyl esters were prepared by trans-esterification, and subsequently analyzed with a Hewlett-Packard 6890 GC.

GC analyses showed the presence of 6.4% to 10.2% EPA in all of the transformants with pZKUE3S grown on MM+5-FOA plates. Two strains (i.e., #4 and #5) that produced 10.2% and 10.1% EPA were designated as Y4158U1 and Y4158U2, respectively.

Generation of Strain Y4184 to Produce About 30.7% EPA of Total Lipids

Construct pZKL2-5U89GC (FIG. 17B; SEQ ID NO:82) was generated to integrate one Δ9 elongase gene, one Δ8 desaturase gene, one Δ5 desaturase gene and one *Yarrowia lipolytica* CPT1 into the Lip2 loci (GenBank Accession No. AJ012632) of Y4158U1, thereby resulting in isolation of strain Y4184. The pZKL2-5U89GC plasmid contained the following components:

TABLE 24

Description of Plasmid pZKL2-5U89GC (SEQ ID NO: 82)

| RE Sites And Nucleotides Within SEQ ID NO: 82 | Description Of Fragment And Chimeric Gene Components |
|---|---|
| AscI/BsiWI (730-1) | 722 bp 5' portion of *Yarrowia* Lip2 gene (labeled as "Lip2.5N" in Figure; GenBank Accession No. AJ012632) |
| PacI/SphI (4141-3438) | 697 bp 3' portion of *Yarrowia* Lip2 gene (labeled as "Lip2.3N" in Figure; GenBank Accession No. AJ012632) |
| SwaI/BsiWI (13382-1) | YAT1::YICPT1::Aco, comprising: YAT1: *Yarrowia lipolytica* YAT1 promoter (labeled as "YAT" in Figure; Patent Publication US 2006/0094102-A1); YICPT1: *Yarrowia lipolytica* diacylglycerol cholinephosphotransferase gene (SEQ ID NO: 80) (labeled as "CPT1" in Figure; PCT Publication No. WO 2006/052870); Aco: Aco terminator sequence from *Yarrowia* Aco gene (GenBank Accession No. AJ001300) |

TABLE 24-continued

Description of Plasmid pZKL2-5U89GC (SEQ ID NO: 82)

| RE Sites And Nucleotides Within SEQ ID NO: 82 | Description Of Fragment And Chimeric Gene Components |
|---|---|
| PmeI/SwaI (10745-13382) | FBAIN::EgD8M::Lip1 comprising: FBAIN: *Yarrowia lipolytica* FBAIN promoter (PCT Publication No. WO 2005/049805; U.S. Pat. No. 7,202,356); EgD8M: Synthetic mutant Δ8 desaturase (SEQ ID NO: 58) (labeled as "D8S-23" in Figure; U.S. Patent Application No. 11/635,258), derived from *Euglena gracilis* ("EgD8S"; PCT Publication No. WO 2006/012326); Lip1: Lip1 terminator sequence from *Yarrowia* Lip1 gene (GenBank Accession No. Z50020) |
| PmeI/ClaI (10745-8650) | GPD::EgD9eS::Lip2, comprising: GPD: *Yarrowia lipolytica* GPD promoter (labeled as "GPD Pro" in Figure; PCT Publication No. WO 2005/003310); EgD9eS: codon-optimized D9 elongase gene (SEQ ID NO: 50), derived from *Euglena gracilis* (labeled as "EgD9ES" in Figure; PCT Publication No. WO 2007/061742); Lip2: Lip2 terminator sequence from *Yarrowia* Lip2 gene (GenBank Accession No. AJ012632) |
| ClaI/EcoRI (8650-6581) | *Yarrowia* Ura3 gene (GenBank Accession No. AJ306421) |
| EcoRI/PacI (6581-4141) | YAT1::EgD5S::ACO, comprising: YAT1: *Yarrowia lipolytica* YAT1 promoter (labeled as "YAT" in Figure; Patent Publication US 2006/0094102-A1); EgD5S: codon-optimized Δ5 desaturase (SEQ ID NO: 63), derived from *Euglena gracilis* (U.S. Patent Application No. 11/748,629); Aco: Aco terminator sequence from *Yarrowia* Aco gene (GenBank Accession No. AJ001300) |

The pZKL2-5U89GC plasmid was digested with AscI/SphI, and then used for transformation of strain Y4158U1 according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in High Glucose Media and then shaken at 250 rpm/min for 5 days. The cells were collected by centrifugation, lipids were extracted, and fatty acid methyl esters were prepared by trans-esterification, and subsequently analyzed with a Hewlett-Packard 6890 GC.

GC analyses showed that most of the selected 96 strains produced 22.5-26.8% EPA of total lipids. There were three strains (i.e., #36, #47 and #65) that produced about 30.7%, 29.1% and 29.2% EPA of total lipids. These three strains were designated as Y4184, Y4185 and Y4186, respectively.

The final genotype of strain Y4184 with respect to wildtype *Yarrowia lipolytica* ATCC #20362 was unknown 1–, unknown 2–, unknown 3–, unknown 4–, unknown 5–, unknown 6–, GPD::FmD12::Pex20, YAT1::FmD12::Oct, GPM/FBAIN::FmD12S::Oct, EXP1::FmD12S::Aco, YAT1::ME3S::Pex16, EXP1::ME3S::Pex20 (2 copies), GPAT::EgD9e::Lip2, EXP1::EgD9e::Lip1, FBAINm::EgD9eS::Lip2, FBA::EgD9eS::Pex20, YAT1::EgD9eS::Lip2, GPD::EgD9eS::Lip2, GPDIN::EgD8M::Lip1, YAT1::EgD8M::Aco, EXP1::EgD8M::Pex16, FBAINm::EgD8M::Pex20, FBAIN::EgD8M::Lip1 (2 copies), EXP1::EgD5S::Pex20, YAT1::EgD5S::Aco, YAT1::RD5S::Oct, FBAIN::EgD5::Aco, FBAINm::PaD17::Aco, EXP1::PaD17::Pex16, YAT1::PaD17S::Lip1, YAT1::YICPT1::Aco, GPD::YICPT1::Aco.

Generation of Strain Y4184U (Ura3–)

In order to disrupt the Ura3 gene in strain Y4184, construct pZKUE3S (FIG. 16B; SEQ ID NO:78) was used to integrate an EXP1::ME3S::Pex20 chimeric gene into the Ura3 gene of strain Y4184.

A total of 11 transformants grown on MM+5-FOA plates were picked and re-streaked onto MM plates and MM+5-FOA plates, separately. All 11 strains had a Ura– phenotype (i.e., cells could grow on MM+5-FOA plates, but not on MM plates). The cells were scraped from the MM+5-FOA plates, lipids were extracted, and fatty acid methyl esters were prepared by trans-esterification, and subsequently analyzed with a Hewlett-Packard 6890 GC.

GC analyses showed the presence of 11.2%, 10.6% and 15.5% EPA in the #7, #8 and #10 transformants with pZKUE3S grown on MM+5-FOA plates. These three strains were designated as strains Y4184U1, Y4184U2 and Y4184U4, respectively.

The discrepancy in the % EPA quantified in Y4184 (30.7%) versus Y4184U (average 12.4%) is based on differing growth conditions. Specifically, the former culture was analyzed following two days of growth in liquid culture, while the latter culture was analyzed after growth on an agar plate. The Applicants have observed a 2-3 fold increase in % EPA, when comparing results from agar plates to those in liquid culture. Thus, although results are not directly comparable, both Y4184 and Y4184U strains demonstrate high production of EPA.

Example 8

Figure 18:
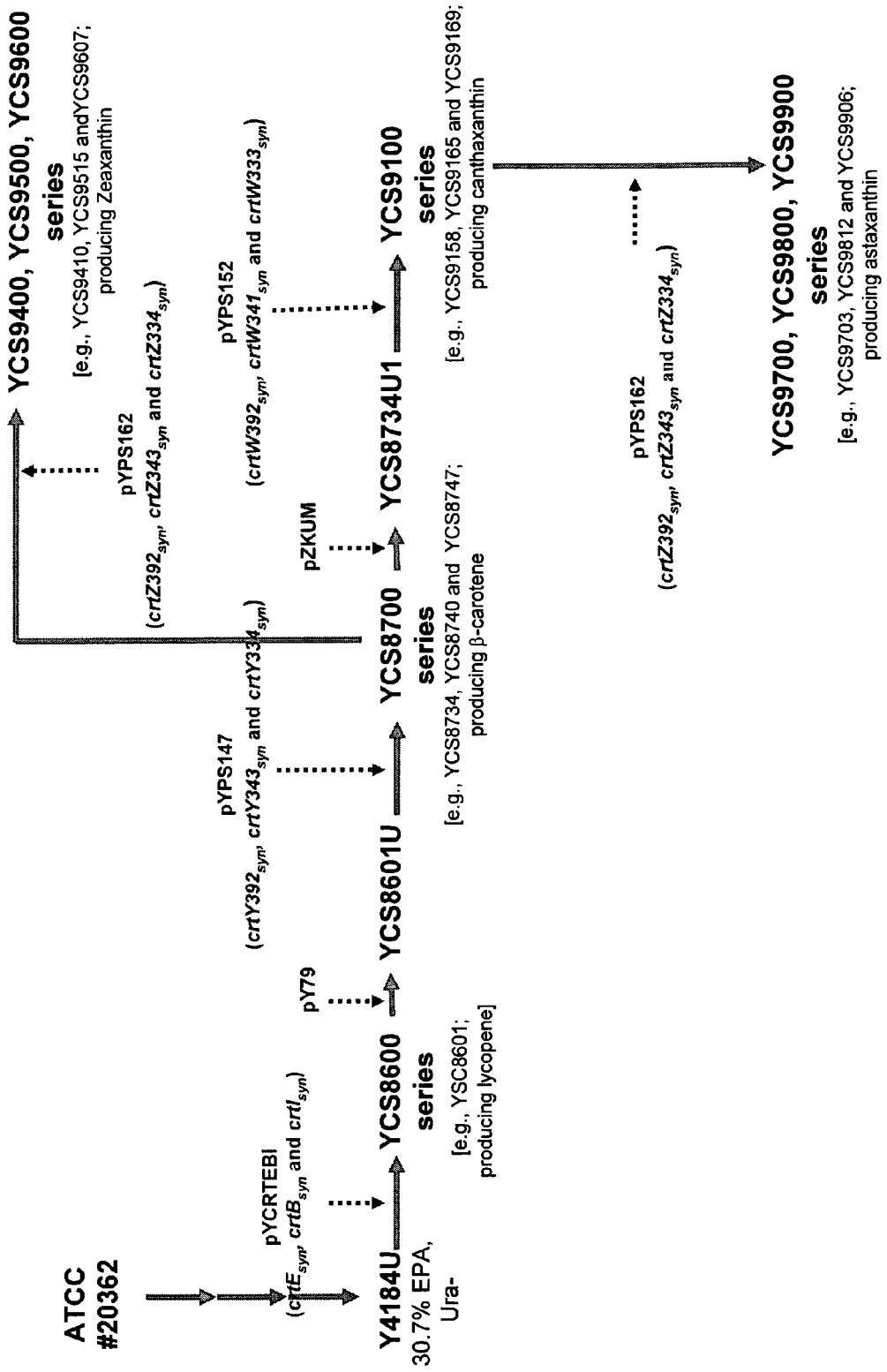
FIG. 18 diagrams the development of some *Yarrowia lipolytica* strains producing various carotenoids and ω-3 PUFAs.

Synthesis of *Yarrowia lipolytica* Strain Series YCS8600, Producing Lycopene and Omega-3 PUFAs The present Example describes the construction of the *Yarrowia lipolytica* YCS8600 strain series, co-producing lycopene and ω-3 PUFAs (FIG. 18). Strain YCS8601U served as the host strain in Example 10, infra, for creation of the YCS8700 series of carotenoid-producing *Y. lipolytica* transformants.

As described herein, construction of the *Y. lipolytica* YCS8600 series required: (1) transformation of *Yarrowia lipolytica* strain Y4184U4 with plasmid pYCRTEBI, comprising chimeric $crtE_{syn}$, $crtB_{syn}$ and $crtI_{syn}$ genes; and, (2) extraction and analysis of the carotenoids produced.

Transformation of *Yarrowia* Strain Y4184U4 with Integration Plasmid pYCRTEBI

The ω-3 producing strain, *Yarrowia lipolytica* strain Y4184U4 (Example 7), was transformed with the carotenoid integration plasmid pYCRTEBI (Example 2; SEQ ID NO:12; FIG. 5), comprising chimeric FBAIN::$crtE_{syn}$::Lip1, GPDIN::$crtB_{syn}$::Lip2 and EXP1::$crtI_{syn}$::Oct genes. Plasmid DNA was prepared using the Qiagen Spin Miniprep kit according to the manufacturer's protocol (Qiagen, Valencia, Calif.). In preparation for the transformation, pYCRTEBI was linearized by digestion with AscI and SphI. The digestion reaction was separated on an 0.8% agarose gel and the 10.8 kb DNA fragment was excised and gel purified using the Qbiogene Geneclean® II kit according to the manufacturer's protocol (Qbiogene, Carlsbad, Calif.). The transformations were performed as described in Example 1 with the exception that salmon sperm DNA was not added to the transformation buffer. The transformation plates were incubated at 30° C. for approximately 6 days before orange colonies were picked and streaked onto fresh MMLeu agar plates. The transformants were re-streaked onto MM and MMLeu agar plates to determine if integration in the *Yarrowia* Y4184U4 genome was at the leucine site or elsewhere in the chromosome. Growth on the MM and the MMLeu agar plates indicated that none of the transformants had integrated at the leucine site. The 15 lycopene-producing strains (i.e., YCS8601-YCS8611 and YCS8612-YCS8616) were named as the YCS8600 series.

Carotenoid Extraction and Analysis

To determine lycopene titers, each strain in the YCS8600 series was inoculated into 20 mL of FM* without YE media; strains YCS8601 and YCS8602 were additionally inoculated into 20 mL of FM* media. The cultures were grown in 125 mL shake flasks at 30° C. with aeration until they were turbid (approximate $OD_{600}$ was 12-17). In contrast, the YCS8601 and YCS8602 strains grown in FM* were cultured to an approximate $OD_{600}$ of 20-25.

To determine the dry cell weight (DCW) of each culture, 10 mL of each culture was filtered using a magnetic filter funnel (300 mL capacity, 47 mm) (Pal Gelman, Ann Arbor, Mich.). The cells were filtered onto a 47 mm, 0.2 μm polycarbonate Whatman Nuclepore Track-Etch membrane (Whatman Inc., Florham Park, N.J.) to remove the liquid. A 47 mm, 10.0 mm polypropylene separator (Pall Gelman) was also used to enhance the filtration process and concentrate the cells in the middle of the membrane.

For carotenoid extractions, 5 mL of culture was centrifuged (8,000 rpm and 4° C.) in a 50 mL polypropylene tube. To the cell pellet, glass beads (approximately 0.5 mL, 0.5 mm diameter), 2 mL of ethanol and 3 mL of dichloromethane were added and the mixture was vigorously mixed using a Vortex mixer before centrifugation for 10 min at 8,000 rpm and 4° C. The supernatant was transferred to a new 50 mL polypropylene tube and taken to dryness under a stream of nitrogen. The dried carotenoids were re-suspended in 135 μL chloroform, mixed using a Vortex mixer when 2865 μL hexane was added prior to further mixing as described above. Prior to HPLC (Beckman Beckman Coulter, Fullerton, Calif.) analysis, samples were filtered through a 0.2 μm Teflon® filter. The lycopene titers (mg of lycopene/kg of cells) for each strain are listed below in Table 25.

TABLE 25

Lycopene Titers Of The YCS8600 Strain Series

| Strain | Lycopene Titer (mg lycopene/ kg cells) |
|---|---|
| YCS8601 | 2119* |
| YCS8602 | 1264* |
| YCS8601 | 1594 |
| YCS8602 | 655 |
| YCS8603 | 625 |
| YCS8604 | 948 |
| YCS8605 | 792 |
| YCS8606 | 426 |
| YCS8607 | 1165 |
| YCS8608 | 594 |
| YCS8609 | 400 |
| YCS8610 | 596 |
| YCS8611 | 708 |
| YCS8613 | 1063 |
| YCS8614 | 522 |
| YCS8615 | 769 |
| YCS8616 | 601 |

*Lycopene titer obtained following extended growth in FM* media, as opposed to in FM* without YE media.

The ura marker was removed from *Yarrowia* strains YCS8601, YCS8607 and YCS8613 (which had the highest lycopene titers when grown in FM* without YE media) via transformation with pY79, as described in Example 3. For each strain, ~150 colonies were patched onto MM and MMU agar plates. One colony from strain YCS8601 grew on the MMU medium containing plate. This colony was re-streaked onto MM, MMU and YPD agar plates to reconfirm its growth characteristic and was given the new name YCS8601U.

Colonies from strains YCS8607 and YCS8613 grew on both media, therefore suggesting that the Ura3 gene was still present in the genomes of these two strains. The cells were confirmed to have lost the mutant AHAS-containing plasmid (i.e., pY79) by their ability to grow only on the MMU agar plates and not on the MMU+SU agar plates.

Example 9

Construction of Additional Synthetic Codon-Optimized crtY, crtW and crtZ Genes for Overexpression in *Yarrowia lipolytica*

Although the construction of the β-carotene-producing YSC1200 and YSC1300 series (Example 5), zeaxanthin-producing YSC3700 and YSC4100 series (Example 6) and canthaxanthin-producing YSC4000 series (Example 6) was suitable to demonstrate feasibility of engineering carotenoid production in *Yarrowia lipolytica*, it is well known that gene expression can be increased by increasing the number of copies of the cloned gene(s).

The present Example describes the construction of various synthetic $crtY_{syn}$, $crtW_{syn}$ and $crtZ_{syn}$ genes suitable for expression in the *Yarrowia lipolytica* YCS8600 strain series (Example 8), to thereby enable higher-level co-production of β-carotene, zeaxanthin, canthaxanthin and/or astaxanthin in conjunction with ω-3 PUFAs. These synthetic genes were then incorporated into genetic constructs to produce expression plasmids pYPS147, pYPS152 and pYPS162 (described and expressed in Examples 10-13, infra).

Selected wildtype and codon-optimized crtY, crtW and crtZ genes contained within expression plasmids pDCQ333, pDCQ334, pDCQ341 and pDCQ343 (described below in Table 26) were codon-optimized based on the codon usage preference for *Yarrowia lipolytica* (see U.S. Pat. No. 7,125,672). Nomenclature is similar to that utilized to describe the DCQ392 gene cluster comprising crtWZEidiYIB in plasmid pDCQ392 (Example 5).

The synthetic genes were produced by GenScript Corp. (Piscataway, N.J.) and provided in the high-copy vector pUC57 (GenBank® Accession No. Y14837). This resulted in creation of the synthetic codon-optimized $crtY_{syn}$, $crtW_{syn}$ and $crtZ_{syn}$ genes, as described below in Table 27.

TABLE 27

Codon-Optimized Carotenoid Biosynthesis Genes

| Carotenoid Gene | Plasmid Source | Organism Source | Nucleotide SEQ ID NO | Amino Acid SEQ ID NO |
|---|---|---|---|---|
| $crtY343_{syn}$ | pDCQ343 | Enterobacteriaceae DC260 | 83 | 84 |
| $crtY334_{syn}$ | pDCQ334 | *Pantoea agglomerans* DC404 | 85 | 86 |
| $crtW341_{syn}$ | pDCQ341 | *Sphingomonas melonis* DC18 | 87 | 88 |
| $crtW333_{syn}$ | pDCQ333 | *Agrobacterium aurantiacum* | 89 | 90 |
| $crtZ343_{syn}$ | pDCQ343 | *Brevundimonas vesicularis* DC263 | 91* | 92 |
| $crtZ334_{syn}$ | pDCQ334 | *Agrobacterium aurantiacum* | 93 | 94 |

*Note: Both SEQ ID NO: 91 ($crtZ343_{syn}$) and SEQ ID NO: 41 ($crtZ392_{syn}$) were codon-optimized for expression in *Yarrowia lipolytica*, based on the same wildtype *Brevundimonas vesicularis* DC263 gene (i.e., SEQ ID NO: 18; $crtZ_{392}$); however, codon degeneracy resulted in two different sequences that share only ~85% identity with one another.

All genes were excised from the pUC57 derived vectors by digestion with NcoI/NotI, fragments were run on 0.8% agarose gels, and the appropriate sized fragments were excised from the gel. In this way, DNA encoding $crtY343_{syn}$, $crtY334_{syn}$, $crtW341_{syn}$, $crtW333_{syn}$, $crtZ343_{syn}$, and $crtZ334_{syn}$ were extracted and then purified with the Qbiogene Geneclean® kit, in preparation for construction of integration vectors pYPS147, pYPS152 and pYPS162. The genes were used in conjunction with $crtY392_{syn}$, $crtZ392_{syn}$ and $crtW392_{syn}$, (Table 13 of Example 6).

TABLE 26

Sources Of Carotenoid Biosynthetic Genes

| Plasmid (Reference) | Complete Crt Cluster Within Plasmid; Product | Origin of crtY Within Plasmid (Reference) | Origin of crtW Within Plasmid (Reference) | Origin of crtZ Within Plasmid (Reference) |
|---|---|---|---|---|
| pDCQ333 (U.S. Pat. No. 7,232,666) | crtWEidiYIB; canthaxanthin | *Pantoea agglomerans* DC404 (U.S. Pat. No. 6,929,928) | *Agrobacterium aurantiacum*\* (U.S. Pat. No. 5,972,690, U.S. Pat. No. 6,150,130; also U.S. Pat. No. 7,232,666*) | — |
| pDCQ334 (U.S. Pat. No. 7,232,666) | crtWZEidiYIB; astaxanthin | *Pantoea agglomerans* DC404 (U.S. Pat. No. 6,929,928) | *Agrobacterium aurantiacum*\* (U.S. Pat. No. 5,972,690, U.S. Pat. No. 6,150,130; also U.S. Pat. No. 7,232,666*) | *Agrobacterium aurantiacum*\* (U.S. Pat. No. 5,811,273; also U.S. Pat. No. 7,232,666*) |
| pDCQ341 (U.S. Pat. No. 7,252,985;) | crtWEYIB; canthaxanthin | Enterobacteriaceae DC260 (U.S. Pat. No. 7,064,196; Sedkova, N., et al., *Appl. Environ. Microbiol.*, 71 (12): 8141-8146 (2005)) | *Sphingomonas melonis* DC18 (U.S. Pat. No. 7,252,985) | — |
| pDCQ343 (U.S. Pat. No. 7,217,537) | crtWZEYIB; astaxanthin | Enterobacteriaceae DC260 (U.S. Pat. No. 7,064,196; Sedkova, N., et al., supra) | *Sphingomonas melonis* DC18 (U.S. Pat. No. 7,252,985) | *Brevundimonas vesicularis* DC263 (U.S. Pat. No. 7,091,031; Tao, L., et al., Gene, 379: 101-108 (2006)) |

Gene in plasmid was subjected to codon-optimization for the pink-pigmented methanotrophic bacterial strain, *Methylomonas* sp. 16a, as described in U.S. Pat. No. 7,232,666.

Example 10

Synthesis of *Yarrowia lipolytica* Strain Series YCS8700, Producing β-Carotene and Omega-3 PUFAs The present Example describes the construction of the *Yarrowia lipolytica* YCS8700 strain series, co-producing β-carotene and ω-3 PUFAs (FIG. 18). Strains YCS8734, YSC8740 and YCS8747 served as the host strains in Examples 11 and 12, infra, for creation of the YCS9100, YCS9400, YCS9500 and YCS9600 series of carotenoid-producing *Y. lipolytica* transformants.

As described herein, construction of the *Y. lipolytica* YCS8700 series required: (1) construction of plasmid pYPS147, comprising three different chimeric crtY genes; (2) transformation of Ura– strain YSC8601U (producing lycopene) with plasmid pYPS147; and, (3) extraction and analysis of the carotenoids produced.

Construction of pYPS147, Comprising Three crtY Genes

Figure 19:
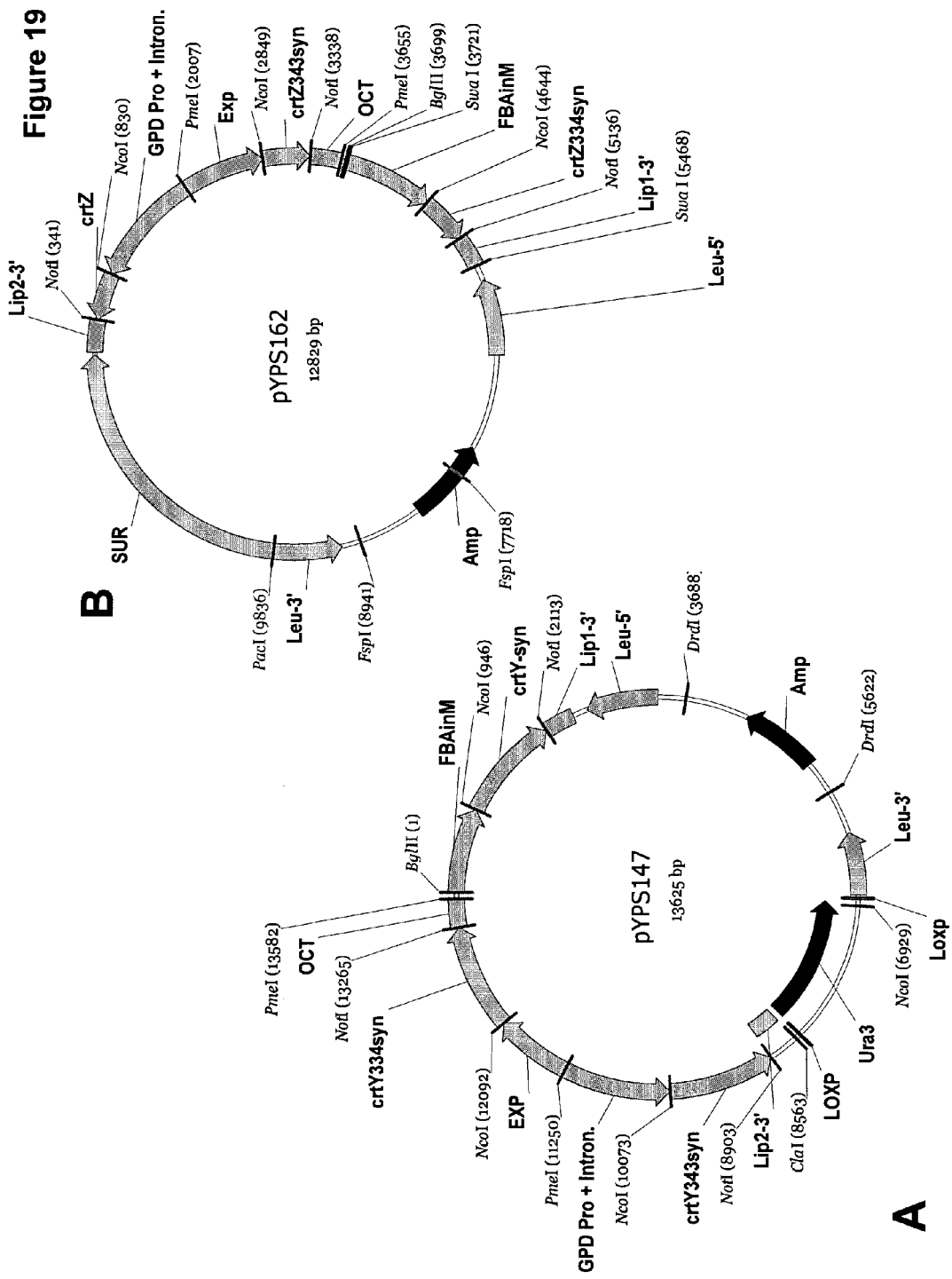
FIG. 19 provides plasmid maps for the following: (A) pYPS147; and, (B) pYPS162.

Plasmid pYPS147 (FIG. 19A; SEQ ID NO:95) was constructed to contain three different chimeric crtY genes (i.e., FBAINm::crtY392$_{syn}$::Lip1, GDPIN::crtY343$_{syn}$::Lip2 and EXP1::crtY334$_{syn}$::OCT), using a series of 4-way ligations to consecutively create each expression cassette (i.e., comprising a promoter, crt gene, and terminator) within an existing vector backbone. After each ligation, the reaction was transformed into *E. coli* XL2 Blue cells (Stratagene) and transformants were screened via colony PCR using the MasterAmp™ Taq protocol of the General Methods, to identify the plasmid having the correct configuration.

The pYPS147 plasmid contained the following components:

TABLE 28

Description of Plasmid pYPS147 (SEQ ID NO: 95)

| RE Sites And Nucleotides Within SEQ ID NO: 95 | Description Of Fragment And Chimeric Gene Components |
|---|---|
| AscI/BsiWI (3395-2601) | 795 bp 5' portion of *Yarrowia* Leu2 gene (GenBank Accession No. AF260230) |
| PacI/SphI (6812-6104) | 709 bp 3' portion of *Yarrowia* Leu2 gene (GenBank Accession No. AF260230) |
| SwaI/SwaI (23-2444) | FBAINm::crtY392$_{syn}$::Lip1, comprising: FBAINm: *Yarrowia lipolytica* FBAIN promoter (PCT Publication No. WO 2005/049805; U.S. Pat. No. 7,202,356); crtY392$_{syn}$: codon-optimized crtY (SEQ ID NO: 37), derived from *Pantoea stewartii* DC413 (labeled as "crtY-syn" in Figure; U.S. Pat. No. 7,288,387); Lip1: Lip1 terminator sequence from *Yarrowia* Lip1 gene (GenBank Accession No. Z50020) |
| PmeI/ClaI (11249-8563) | GPDIN::crtY343$_{syn}$::Lip2, comprising: GPDIN: *Yarrowia lipolytica* GPDIN promoter (labeled as "GPD Pro + Intron" in Figure; Patent Publication US 2006/0019297-A1); crtY343$_{syn}$: codon-optimized crtY (SEQ ID NO: 83), derived from Enterobacteriaceae DC260 (U.S. Pat. No. 7,064,196); Lip2: Lip2 terminator sequence from *Yarrowia* Lip2 gene (GenBank Accession No. AJ012632) |
| PmeI/BglII (11250--13625) | EXP1::crtY334$_{syn}$::OCT, comprising: EXP1: *Yarrowia lipolytica* export protein (EXP1) promoter (labeled as "EXP" in Figure; PCT Publication No. WO 2006/052870 and U.S. Patent Application No. 11/265,761); crtY334$_{syn}$: codon-optimized crtY (SEQ ID NO: 85), derived from *Pantoea agglomerans* DC404 (U.S. Pat. No. 6,929,928); OCT: OCT terminator sequence of *Yarrowia* OCT gene (GenBank Accession No. X69988) |
| 8537-6844 | LoxP::Ura3::LoxP, comprising: LoxP sequence (SEQ ID NO: 9); *Yarrowia* Ura3 gene (GenBank Accession No. AJ306421); LoxP sequence (SEQ ID NO: 9) |
| 5244-4384 | Ampicillin-resistance gene (Amp$^R$) for selection in *E. coli* |

Generation and Analysis of β-Carotene-Producing Strains

The pYPS147 plasmid was digested DrdI, separated on an 0.8% agarose gel and purified using the Qbiogene Geneclean II kit. The resulting pYPS147 fragment was then used for transformation of lycopene-producing *Yarrowia* strain YCS8601U (Example 8), according to the methodology of Example 1.

The transformant cells were plated onto MMLeu agar plates. Colonies present after 4 days of incubation at 30° C. were pink and yellow in color. The pink colonies were similar to cells present on the cells alone control plate, which suggested that they were background colonies and not real transformants. The yellowish and orange colonies were re-streaked and the new strains were given names as a part of the YCS8700 series.

To determine whether the strains were able to convert lycopene into β-carotene due to the expression of the β-carotene cyclase (i.e., crtY) genes, 20 mL cultures were grown in FM* for 48 hrs with aeration in 125 mL shake flasks. All of the cultures grew to similar ODs. Two milliliters of each culture were harvested in tubes used for bead beating. To each tube ~100 μL of 0.5 mm glass beads were added along with 400 μL of methanol. The tubes were put into the Bead-Beater™ apparatus (BioSpec Products, Inc., Bartlesville, Okla.) for 5 min at high speed. The samples were mixed by rocking for 20 min on an oscillator. To each tube, 50 μL of NaCl (1.0 M), 200 μL of chloroform and 400 μL hexane were added, samples were mixed using a Vortex mixer and carotenoids were partitioned into the organic layer following centrifugation for 10 min in a microfuge. The organic top layer, containing the carotenoids, was transferred to a new microfuge tube using a glass Pasteur pipette. Samples were passed through a Teflon® filter (0.2 μm) prior to HPLC analysis using a reverse-phase $C_{18}$ column as described in Example 5.

As shown in Table 29, the level of β-carotene produced by various strains in the YCS8700 series ranged from 22% to 66% (of total carotenoids). The amount of β-carotene made by the strains, as determined by the "area of the β-carotene peaks", ranged from ~1150 for strain YCS8704 to ~5690 for strain YCS8740. The color of the pellet was not indicative of the relative amount of β-carotene produced by the strains. Strain YCS8601 (row shaded in gray) was the control strain, which did not contain the crtY genes and thus could not produce β-carotene.

TABLE 29

β-carotene Production In The YCS8700 Strain Series

| Strain* | Lycopene (% of total carotenoid) | β-carotene (% of total carotenoid) | Pellet Color | Area of β-carotene Peaks |
|---|---|---|---|---|
| YCS8601 | 71 | — | Red | — |
| YCS8701 | 4 | 45 | Yellow | 2380 |
| YCS8702 | 4 | 46 | Yellow | 2500 |
| YCS8703 | 22 | 29 | Orange | 1580 |
| YCS8704 | 30 | 22 | Orange | 1150 |
| YCS8705 | 24 | 28 | Orange | 1440 |
| YCS8706 | 7 | 48 | Yellow | 2950 |
| YCS8707 | 25 | 27 | Orange | 1310 |
| YCS8708 | 4 | 51 | Yellow | 3020 |
| YCS8709 | 5 | 50 | Orange | 2680 |
| YCS8710 | 17 | 38 | Orange | 2015 |
| YCS8711 | 4 | 54 | Yellow | 3450 |
| YCS8712 | 4 | 53 | Yellow | 3800 |
| YCS8713 | 4 | 51 | Yellow | 3000 |
| YCS8714 | 19 | 35 | Orange | 2060 |
| YCS8715 | 4 | 53 | Yellow | 3330 |
| YCS8716 | 18 | 45 | Orange | 5060 |
| YCS8717 | 5 | 61 | Yellow | 4370 |
| YCS8718 | 4 | 60 | Yellow | 4240 |
| YCS8719 | 22 | 40 | Orange | 2070 |
| YCS8720 | 24 | 36 | Orange | 2180 |
| YCS8721 | 25 | 37 | Orange | 2530 |
| YCS8722 | 4 | 63 | Yellow | 4610 |
| YCS8723 | 22 | 40 | Orange | 2400 |
| YCS8724 | 4 | 63 | Yellow | 4770 |
| YCS8725 | 3 | 66 | Yellow | 4890 |
| YCS8726 | 26 | 38 | Orange | 2500 |
| YCS8727 | 22 | 42 | Orange | 2680 |
| YCS8728 | 20 | 45 | Orange | 3010 |
| YCS8729 | 4 | 65 | Yellow | 2730 |
| YCS8730 | 5 | 62 | Yellow | 4550 |
| YCS8731 | 31 | 34 | Orange | 2850 |
| YCS8732 | 6 | 61 | Yellow | 1930 |
| YCS8733 | 7 | 61 | Yellow | 2020 |
| YCS8734 | 5 | 63 | Orange | 5080 |
| YCS8735 | 5 | 62 | Orange | 4630 |
| YCS8736 | 24 | 39 | Orange | 2580 |
| YCS8737 | 4 | 63 | Orange | 4690 |
| YCS8738 | 4 | 63 | Yellow | 4630 |
| YCS8739 | 22 | 43 | Orange | 2700 |
| YCS8740 | 5 | 64 | Orange | 5690 |
| YCS8741 | 6 | 63 | Orange | 4670 |
| YCS8742 | 7 | 62 | Orange | 4614 |
| YCS8743 | 22 | 43 | Orange | 2870 |
| YCS8744 | 4 | 65 | Yellow | 4410 |
| YCS8745 | 27 | 38 | Orange | 2350 |
| YCS8746 | 6 | 62 | Orange | 4580 |
| YCS8747 | 6 | 66 | Orange | 4410 |

*Strains selected for further evaluation are highlighted in bold.

Example 11

Synthesis of Yarrowia lipolytica Strain Series YCS9400, YCS9500 and YCS9600, Producing Zeaxanthin and Omega-3 PUFAs The present Example describes the construction of the Yarrowia lipolytica YCS9400, YCS9500 and YCS9600 strain series, co-producing zeaxanthin and ω-3 PUFAs (FIG. 18).

As described herein, construction of the *Y. lipolytica* YCS9400, YCS9500 and YCS9600 series required: (1) construction of plasmid pYPS162, comprising three different chimeric crtZ genes; (2) transformation of *Yarrowia lipolytica* strains YCS8734, YCS8740 and YCS8747 (producing β-carotene), with plasmid pYPS162; and, (3) extraction and analysis of the carotenoids produced.

Construction of pYPS162, Comprising Three crtZ Genes

Plasmid pYPS162 (FIG. 19B; SEQ ID NO:96) was constructed to contain three different chimeric crtZ genes (i.e., FBAIN::crtZ334$_{syn}$::Lip, GDPIN::crtZ392$_{syn}$::Lip2 and EXP1::crtZ343$_{syn}$::OCT), using methodology similar to that described for construction of pYPS147 (Example 10). The pYPS162 plasmid contained the following components:

TABLE 30

Description of Plasmid pYPS162 (SEQ ID NO: 96)

| RE Sites And Nucleotides Within SEQ ID NO: 96 | Description Of Fragment And Chimeric Gene Components |
|---|---|
| AscI/BsiWI 6418-5624 | 795 bp 5' portion of *Yarrowia* Leu2 gene (GenBank Accession No. AF260230) |
| PacI/SphI 9835-9127 | 709 bp 3' portion of *Yarrowia* Leu2 gene (GenBank Accession No. AF260230) |
| BglII/SwaI 3699-5467 | FBAIN::crtZ334$_{syn}$ ::Lip1, comprising: FBAINm: *Yarrowia lipolytica* FBAIN promoter (PCT Publication No. WO 2005/049805; U.S. Pat. No. 7,202,356); crtZ334$_{syn}$: codon-optimized crtZ (SEQ ID NO: 93), derived from *Agrobacterium aurantiacum* (U.S. Pat. No. 7,232,666); Lip1: Lip1 terminator sequence from *Yarrowia* Lip1 gene (GenBank Accession No. Z50020) |
| 2006-5 | GPDIN::crtZ392$_{syn}$::Lip2, comprising: GPDIN: *Yarrowia lipolytica* GPDIN promoter (labeled as "GPD Pro + Intron" in Figure; Patent Publication US 2006/0019297-A1); crtZ392$_{syn}$: codon-optimized crtZ (SEQ ID NO: 41), derived from *Brevundimonas vesicularis* DC263 (labeled as "crtZ" in Figure; U.S. Pat. No. 7,091,031); Lip2: Lip2 terminator sequence from *Yarrowia* Lip2 gene (GenBank Accession No. AJ012632) |
| PmeI/BglII 2007-3698 | EXP1::crtZ343$_{syn}$::OCT, comprising: EXP1: *Yarrowia lipolytica* export protein (EXP1) promoter (labeled as "EXP" in Figure; PCT Publication No. WO 2006/052870 and U.S. Patent Application No. 11/265,761); crtZ343$_{syn}$: codon-optimized crtZ (SEQ ID NO: 91), derived from *Brevundimonas vesicularis* DC263 (U.S. Pat. No. 7,091,031); OCT: OCT terminator sequence of *Yarrowia* OCT gene (GenBank Accession No. X69988) |
| 9836-12825 | *Yarrowia lipolytica* AHAS gene (GenBank Accession No. XP_501277) comprising a W497L mutation (SEQ ID NO: 1) (labeled as "SUR" in Figure; PCT Publication No. WO 2006/052870) |
| 8267-7407 | Ampicillin-resistance gene (Amp$^R$) for selection in *E. coli* |

Generation and Analysis of Zeaxanthin-Producing Strains

The pYPS162 plasmid was digested FspI and then used for transformation of the α-carotene-producing *Yarrowia* strains YCS8734, YCS8740 and YCS8747 (Example 10), according to the methodology of Example 1.

The transformant cells were plated onto MM+SU agar plates and maintained at 30° C. for 3 to 4 days. The transformants obtained from the YCS8734, YCS8740 and YCS8747 transformations were designated as a part of the YCS9400, YCS9500 and YCS9600 series, respectively. Single colonies of each were re-streaked onto MM plates and isolated colonies were inoculated into FM*.

To determine the ability of the strains to convert β-carotene into zeaxanthin due to the expression of the β-carotene hydroxylase (i.e., crtZ) genes, 20 mL cultures were grown for 48 hr in 125 mL capacity shake flasks with aeration. The cultures had similar ODs (approximate $OD_{600}$ was 20-25) at end of the incubation. Carotenoids were extracted as described above in Example 10.

The percent of lycopene, β-carotene and zeaxanthin accumulated in individual strains within the YCS9400, YCS9500 and YCS9600 series are shown in Table 31. Strains YCS8734, YCS8740 and YCS8747 (rows shaded in gray) are the control strains, which do not contain the β-carotene hydroxylase and thus can not produce zeaxanthin. The strains having the highest levels of zeaxanthin are highlighted in bold font. As expected, the zeaxanthin-producing strains showed a decrease in their percentages of lycopene and β-carotene.

TABLE 31

Lycopene, β-Carotene And Zeaxanthin Production In The YCS9400, YCS9500 And YCS9600 Strain Series

| Strain | Lycopene/ β-Carotene (% of total carotenoid) | Zeaxanthin (% of total carotenoid) | Strain | Lycopene/ β-Carotene (% of total carotenoid) | Zeaxanthin (% of total carotenoid) |
|---|---|---|---|---|---|
| YCS8734 | 94 | — | YCS9508 | 81 | 12 |
| YCS9401 | 64 | 28 | YCS9509 | 94 | — |
| YCS9402 | 62 | 31 | YCS9510 | 94 | — |
| YCS9403 | 62 | 32 | YCS9511 | 92 | — |
| YCS9404 | 94 | — | YCS9512 | 93 | — |
| YCS9405 | 94 | — | YCS9513 | 93 | — |
| YCS9406 | 61 | 32 | YCS9514 | 68 | 24 |
| YCS9407 | 72 | 22 | YCS9515 | 38 | 55 |
| YCS9408 | 63 | 28 | YCS8747 | 93 | — |
| YCS9409 | 94 | — | YCS9601 | 57 | 37 |
| YCS9410 | 54 | 40 | YCS9602 | 57 | 36 |
| YCS9411 | 94 | — | YCS9603 | 79 | 13 |
| YCS9412 | 95 | — | YCS9604 | 94 | — |
| YCS9413 | 94 | — | YCS9605 | 61 | 32 |
| YCS9414 | 93 | — | YCS9606 | 59 | 35 |
| YCS9415 | 68 | 26 | YCS9607 | 48 | 47 |
| YCS8740 | 93 | — | YCS9608 | 63 | 30 |
| YCS9501 | 72 | 20 | YCS9609 | 85 | 7 |
| YCS9502 | 93 | — | YCS9610 | 67 | 26 |
| YCS9503 | 67 | 27 | YCS9611 | 94 | — |
| YCS9504 | 60 | 33 | YCS9612 | 77 | 16 |
| YCS9505 | 72 | 21 | YCS9613 | 56 | 38 |
| YCS9506 | 94 | — | YCS9614 | 56 | 38 |
| YCS9507 | 94 | — | YCS9615 | 82 | 12 |

*Strains selected for further evaluation are highlighted in bold.

Example 12

Synthesis of *Yarrowia lipolytica* Strain Series YCS9100, Producing Canthaxantin and Omega-3 PUFAs The present Example describes the construction of the *Yarrowia lipolytica* YCS9100 strain series, co-producing canthaxanthin and ω-3 PUFAs (FIG. 18). Strains YCS8158, YCS9165 and YCS9169 served as the host strains in Example 13, infra, for creation of the YCS9700, YCS9800 and YCS9900 series of carotenoid-producing *Y. lipolytica* transformants.

As described herein, construction of the *Y. lipolytica* YCS9100 series required: (1) construction of plasmid pYPS152, comprising three different chimeric crtW genes; (2) generation of Ura3− strains derived from *Yarrowia lipolytica* strains YCS8734, YCS8740 and YCS8747 (producing β-carotene); (3) transformation of the Ura3−, β-carotene-producing strains with plasmid pYPS152; and, (4) extraction and analysis of the carotenoids produced.

Construction of pYPS152, Comprising Three crtW Genes

Figure 20:
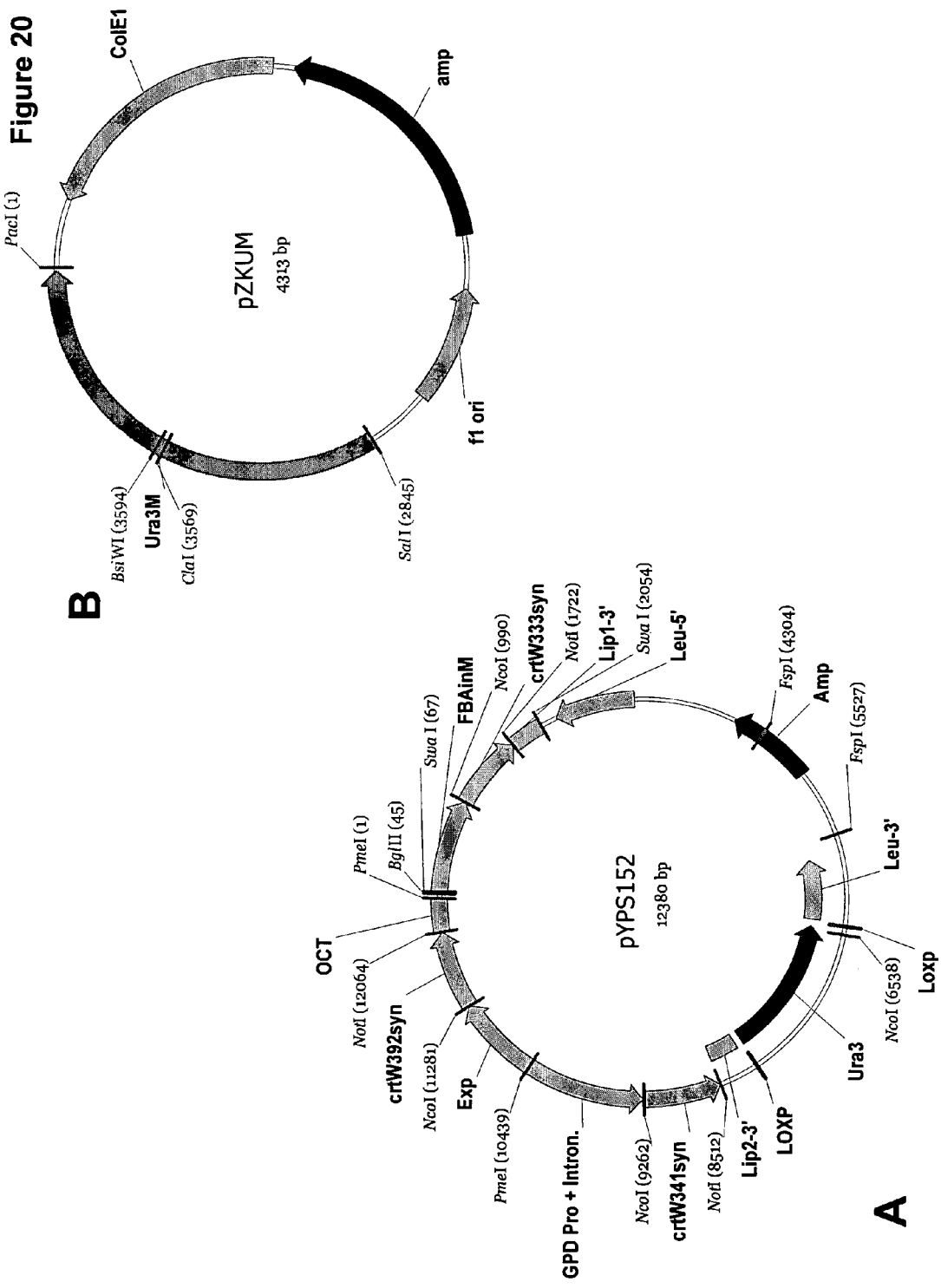
FIG. 20 provides plasmid maps for the following: (A) pYPS152; and, (B) pZKUM.

Plasmid pYPS152 (FIG. 20A; SEQ ID NO:97) was constructed to contain three different chimeric crtY genes (i.e., FBAIN::crtW333$_{syn}$::Lip1, GDPIN::crtW341$_{syn}$::Lip2 and EXP1::crtW392$_{syn}$::OCT), using methodology similar to that described for construction of pYPS147 (Example 10). The pYPS152 plasmid contained the following components:

TABLE 32

Description of Plasmid pYPS152 (SEQ ID NO: 97)

| RE Sites And Nucleotides Within SEQ ID NO: 97 | Description Of Fragment And Chimeric Gene Components |
|---|---|
| AscI/SphI 3004-2210 | 795 bp 5′ portion of *Yarrowia* Leu2 gene (GenBank Accession No. AF260230) |

TABLE 32-continued

Description of Plasmid pYPS152 (SEQ ID NO: 97)

| RE Sites And Nucleotides Within SEQ ID NO: 97 | Description Of Fragment And Chimeric Gene Components |
|---|---|
| PacI/SphI 6421-5713 | 709 bp 3′ portion of *Yarrowia* Leu2 gene (GenBank Accession No. AF260230) |
| BglII/SwaI 45-2053 | FBAINm::crtW333$_{syn}$::Lip1, comprising: FBAINm: *Yarrowia lipolytica* FBAIN promoter (PCT Publication No. WO 2005/049805; U.S. Pat. No. 7,202,356); crtW333$_{syn}$: codon-optimized crtW (SEQ ID NO: 89), derived from *Agrobacterium aurantiacum* (U.S. Pat. No. 7,232,666); Lip1: Lip1 terminator sequence from *Yarrowia* Lip1 gene (GenBank Accession No. Z50020) |

TABLE 32-continued

Description of Plasmid pYPS152 (SEQ ID NO: 97)

| RE Sites And Nucleotides Within SEQ ID NO: 97 | Description Of Fragment And Chimeric Gene Components |
|---|---|
| PmeI/ClaI 10438-8172 | GPDIN::crtW341$_{syn}$::Lip2, comprising:<br>GPDIN: *Yarrowia lipolytica* GPDIN promoter (labeled as "GPD Pro + Intron" in Figure; Patent Publication US 2006/0019297-A1);<br>crtW341$_{syn}$: codon-optimized crtW (SEQ ID NO: 87), derived from *Sphingomonas melonis* DC18 (U.S. Pat. No. 7,252,985);<br>Lip2: Lip2 terminator sequence from *Yarrowia* Lip2 gene (GenBank Accession No. AJ012632) |
| PmeI/BglII 10439-44 | EXP1::crtW392$_{syn}$::OCT, comprising:<br>EXP1: *Yarrowia lipolytica* export protein (EXP1) promoter (labeled as "EXP" in Figure; PCT Publication No. WO 2006/052870 and U.S. Patent Application No. 11/265,761);<br>crtW392$_{syn}$: codon-optimized crtW (SEQ ID NO: 39), derived from *Brevundimonas vesicularis* DC263 (U.S. Pat. No. 7,252,985);<br>OCT: OCT terminator sequence of *Yarrowia* OCT gene (GenBank Accession No. X69988) |
| ClaI/PacI 8171-6422 | LoxP::Ura3::LoxP, comprising:<br>LoxP sequence (SEQ ID NO: 9);<br>*Yarrowia* Ura3 gene (GenBank Accession No. AJ306421);<br>LoxP sequence (SEQ ID NO: 9) |
| 4853-3993 | Ampicillin-resistance gene (Amp$^R$) for selection in *E. coli* |

Generation of Ura3⁻, β-Carotene-Producing *Yarrowia lipolytica* Strains

The β-carotene producing strains YCS8734, YCS8740 and YCS8747 (Example 10) were Ura3⁺. In order to disrupt the Ura3 gene in each of these strains (to thereby enable the Ura3 selectable marker to be "re-used" during subsequent transformations), construct pZKUM (FIG. 20B; SEQ ID NO:98) was used to integrate a Ura3 mutant gene into the Ura3 gene. The plasmid pZKUM contained the following components:

TABLE 33

Description of Plasmid pZKUM (SEQ ID NO: 98)

| RE Sites And Nucleotides Within SEQ ID NO: 98 | Description Of Fragment And Chimeric Gene Components |
|---|---|
| SalI/PacI (32845-1) | Synthetic mutant Ura3 gene (SEQ ID NO: 99, wherein the 1459 bp DNA fragment contains a 33 bp deletion from +21 to +53, a 1 bp deletion at +376 and a 3 bp deletion from +400 to +403 of the *Yarrowia* Ura3 coding region (GenBank Accession No. AJ306421)) |
| 1112-232 | ColE1 plasmid origin of replication |
| 2042-1182 | Ampicillin-resistance gene (Amp$^R$) for selection in *E. coli* |

Following transformations using the linearized pZKUM DNA fragment containing the mutated Ura3 gene into strains YCS8734, YCS8740 and YCS8747, cells were streaked onto MM+5-FOA agar plates. This selection technique allowed identification of transformants having a Ura⁻ phenotype. The phenotype was confirmed after streaking isolated colonies onto MMU agar plates (i.e., cells that had lost the Ura3 gene required the presence of uracil in the growth medium and thus could grow) and MM agar plates (i.e., cells that had lost the Ura3 gene could not grow). Several isolates that were Ura⁻ were given the following new designations: YCS8734U1, YCS8734U2, YCS8734U3, YCS8734U4, YCS8734U6, YCS8740U1, YCS8740U2 and YCS8747U2.

Generation and Analysis of Canthaxanthin-Producing Strains

Plasmid pYPS152 (SEQ ID NO:97) was digested with FspI and then used for transformation of the Ura⁻, β-carotene-producing *Yarrowia* strains YCS8734U1, YCS8734U2, YCS8734U3, YCS8734U4, YCS8740U1 and YCS8747U2 (supra), according to the methodology of Example 1.

The transformant cells were plated onto MM agar plates and maintained at 30° C. for 3 to 4 days. The resulting orange colonies were re-streaked and the new strains were given designations as a part of the YCS9100 series, according to Table 34 below.

TABLE 34

Parentage Of Canthaxanthin-Producing Strains (YCS9100 Series)

| Parent Host | Number Of Colonies Following pYPS152 Transformation | New Strain Designations |
|---|---|---|
| YCS8734U1 | 26 | YCS9101-YCS9126 |
| YCS8734U2 | 22 | YCS9127-YCS9148 |
| YCS8734U3 | 9 | YCS9149-YCS9158 |
| YCS8734U4 | 12 | YCS9159-YCS9171 |

To determine the ability of the YCS9100 series of strains to convert β-carotene into canthaxanthin due to the expression of the β-carotene ketolase (i.e., crtW) genes, 20 mL cultures were grow for 48 hrs in 125 mL capacity shake flasks with aeration. The cultures were grown to similar ODs (approximate OD$_{600}$ was 20-25). Carotenoids were extracted as described in Example 10.

Table 35 shows the percentages of lycopene, β-carotene, echinone and canthaxanthin produced within individual strains of the YCS9100 series. Strain YCS8734 (row shaded in gray) is the control strain, which did not contain the β-carotene ketolase (i.e., crtW) and thus was unable to make canthaxanthin. The amount of canthaxanthin made by the strains is also provided, as determined by the "area of the canthaxanthin peaks".

TABLE 35

% Canthaxanthin Produced By The YCS9100 Series Strains

| Strain | Lycopene (% of total carotenoid) | β-carotene (% of total carotenoid) | Echinone (% of total carotenoid) | Canthaxanthin (% of total carotenoid) | Canthaxanthin + Echinone (% of total carotenoid) | Area of Canthaxanthin Peaks |
|---|---|---|---|---|---|---|
| YCS8734 | 14 | 63 | — | — | — | — |
| YCS9101 | 23 | 16 | 13 | 34 | 47 | 1810 |

TABLE 35-continued

% Canthaxanthin Produced By The YCS9100 Series Strains

| Strain | Lycopene (% of total carotenoid) | β-carotene (% of total carotenoid) | Echinone (% of total carotenoid) | Canthaxanthin (% of total carotenoid) | Canthaxanthin + Echinone (% of total carotenoid) | Area of Canthaxanthin Peaks |
|---|---|---|---|---|---|---|
| YCS9102 | 22 | 40 | 23 | 2 | 26 | 140 |
| YCS9103 | 20 | 31 | 25 | 10 | 35 | 580 |
| YCS9104 | 19 | 32 | 26 | 9 | 36 | 510 |
| YCS9105 | 20 | 28 | 29 | 7 | 36 | 400 |
| YCS9106 | 25 | 54 | — | — | — | — |
| YCS9107 | 27 | 9 | 11 | 39 | 50 | 2300 |
| YCS9108 | 19 | 39 | 24 | — | 24 | — |
| YCS9109 | 30 | 49 | — | — | — | — |
| YCS9110 | 26 | 56 | — | — | — | — |
| YCS9111 | 29 | 54 | — | — | — | — |
| YCS9112 | 29 | 10 | 11 | 35 | 45 | 2270 |
| YCS9113 | 26 | 10 | 11 | 38 | 49 | 2190 |
| YCS9114 | 20 | 40 | 24 | 2 | 26 | 140 |
| YCS9115 | 28 | 55 | — | — | — | — |
| YCS9116 | 20 | 26 | 30 | 7 | 36 | 400 |
| YCS9117 | 19 | 30 | 26 | 9 | 34 | 530 |
| YCS9118 | 27 | 55 | — | — | — | — |
| YCS9119 | 30 | 48 | — | — | — | — |
| YCS9120 | 36 | 46 | — | — | — | — |
| YCS9121 | 36 | 8 | 9 | 30 | 39 | 1820 |
| YCS9122 | 35 | 51 | — | — | — | — |
| YCS9123 | 31 | 9 | 10 | 34 | 44 | 2070 |
| YCS9124 | 33 | 52 | — | — | — | — |
| YCS9125 | 31 | 8 | 13 | 34 | 48 | 1970 |
| YCS9126 | 17 | 39 | 25 | 4 | 29 | 210 |
| YCS9127 | 34 | 7 | 9 | 35 | 44 | 2030 |
| YCS9128 | 36 | 7 | 8 | 34 | 42 | 1950 |
| YCS9129 | 79 | — | — | — | — | — |
| YCS9130 | 32 | 21 | 26 | 6 | 32 | 380 |
| YCS9131 | 41 | 5 | 7 | 32 | 39 | 2370 |
| YCS9132 | 39 | 6 | 7 | 31 | 39 | 2040 |
| YCS9133 | 34 | 7 | 8 | 34 | 43 | 2000 |
| YCS9134 | 28 | 21 | 24 | 12 | 36 | 680 |
| YCS9135 | 35 | 7 | 8 | 36 | 44 | 2090 |
| YCS9136 | 32 | 7 | 9 | 37 | 46 | 2170 |
| YCS9137 | 33 | 7 | 9 | 35 | 44 | 4280 |
| YCS9138 | 37 | 49 | — | — | — | — |
| YCS9139 | 29 | 7 | 13 | 37 | 50 | 1890 |
| YCS9140 | 32 | 7 | 9 | 36 | 45 | 2100 |
| YCS9141 | 23 | 61 | — | — | — | — |
| YCS9142 | 33 | 52 | — | — | — | — |
| YCS9143 | 33 | 7 | 9 | 34 | 43 | 1630 |
| YCS9144 | 39 | 51 | — | — | — | — |
| YCS9145 | 34 | 54 | — | — | — | — |
| YCS9146 | 46 | 42 | — | — | — | — |
| YCS9147 | 43 | 44 | — | — | — | — |
| YCS9148 | 19 | 42 | 23 | 4 | 27 | 240 |
| YCS9149 | 17 | 44 | 24 | 4 | 28 | 260 |
| YCS9150 | 24 | 10 | 19 | 32 | 51 | 2050 |
| YCS9151 | 24 | 9 | 17 | 35 | 52 | 2280 |
| YCS9152 | 26 | 7 | 15 | 34 | 49 | 2100 |
| YCS9153 | 17 | 43 | 21 | 4 | 25 | 270 |
| YCS9154 | 29 | 25 | 21 | 13 | 34 | 500 |
| YCS9155 | 29 | 8 | 16 | 33 | 49 | 1850 |
| YCS9156 | 26 | 59 | — | — | — | — |
| YCS9157 | 14 | 50 | 23 | 3 | 27 | 198 |
| YCS9158 | 23 | 7 | 12 | 43 | 55 | 2664 |
| YCS9159 | 30 | 30 | 23 | 7 | 30 | 363 |
| YCS9160 | 17 | 37 | 27 | 5 | 32 | 352 |
| YCS9161 | 26 | 7 | 12 | 40 | 52 | 2837 |
| YCS9162 | 18 | 8 | 20 | 39 | 59 | 2649 |
| YCS9163 | 20 | 8 | 19 | 40 | 59 | 2950 |
| YCS9164 | 19 | 7 | 16 | 43 | 59 | 3004 |
| YCS9165 | 22 | 5 | 11 | 46 | 56 | 3436 |
| YCS9166 | 18 | 31 | 29 | 11 | 40 | 701 |
| YCS9167 | 21 | 8 | 10 | 44 | 54 | 2665 |
| YCS9168 | 25 | 62 | — | — | — | — |
| YCS9169 | 22 | 9 | 10 | 43 | 53 | 2414 |
| YCS9170 | 27 | 56 | — | — | — | — |
| YCS9171 | 19 | 24 | 25 | 14 | 39 | 659 |

Example 13

Synthesis of *Yarrowia lipolytica* Strain Series YCS9700, YCS9800 and YCS9900, Producing Astaxantin and Omega-3 PUFAs The present Example describes the construction of the *Yarrowia lipolytica* YCS9700, YSC9800 and YCS9900 strain series, co-producing astaxanthin and ω-3 PUFAs (FIG. 18).

As described herein, construction of the *Y. lipolytica* YCS9700, YSC9800 and YCS9900 series required: (1) transformation of *Yarrowia lipolytica* strains YCS9158, YCS9165 and YCS9169 (producing canthaxantin) with plasmid pYPS162; and, (2) extraction and analysis of the carotenoids produced.

Generation and Analysis of Astaxanthin-Producing Strains

Plasmid pYPS162 (SEQ ID NO:96) was digested with FspI and then used for transformation of the canthaxanthin-producing *Yarrowia* strains YCS9158, YCS9165 and YCS9169 (Example 12), according to the methodology of Example 1.

The transformant cells were plated onto MM+SU agar plates and maintained at 30° C. for 3 to 4 days. The resulting red colonies were re-streaked and the new strains were given designations as part of the YCS9700, YSC9800 or YCS9900 series, according to Table 36 below.

TABLE 36

Parentage Of Astaxanthin-Producing Strains (YCS9700, YCS9800 And YCS9900 Series)

| Parent Host | Number Of Colonies Following pYPS162 Transformation | New Strain Designations |
|---|---|---|
| YCS9158 | 15 | YCS9701-YCS9715 |
| YCS9165 | 15 | YCS9801-YCS9815 |
| YCS9169 | 15 | YCS9901-YCS9915 |

To determine the ability of the strains to convert canthaxanthin into astaxanthin due to the expression of the β-carotene hydroxylase (i.e., crtZ) genes, 20 mL cultures were grown for 48 hrs with aeration in 125 mL shake flasks. The cultures had similar ODs at end of the incubation. Carotenoids were extracted as described in Example 10.

The percentage of lycopene, β-carotene, echinone, canthaxanthin and astaxanthin (relative to the total carotenoids) within individual strains of the YCS9700, YSC9800 and YCS9900 series are shown in Table 37. Strains YCS9158, YCS9165 and YCS9169 (rows shaded in gray) are the control strains, which did not contain the β-carotene hydroxylase (i.e., crtZ) and thus were unable to make astaxanthin or adonixanthin. The strains having the highest levels of astaxanthin are highlighted in bold font. As expected, the astaxanthin-producing strains showed a decrease in the percentage of lycopene plus β-carotene that was accumulated.

TABLE 37

% Astaxanthin And Adonixanthin Produced By The YCS9700, YSC9800 and YCS9900 Series Strains

| Strain | Lycopene + β-carotene (%) | Canthaxanthin (%) | Adonirubin (%) | Astaxanthin (%) | Adonixanthin (%) | Carotenoids past β-carotene (%) |
|---|---|---|---|---|---|---|
| YCS9158 | 54 | 36 | — | — | — | 36 |
| YCS9701 | 63 | 1 | 1 | 13 | 14 | 28 |
| YCS9702 | 65 | 13 | — | 8 | 5 | 26 |
| YCS9703 | 47 | 14 | 6 | 25 | 1 | 46 |
| YCS9704 | 77 | — | — | 10 | 4 | 14 |
| YCS9705 | 67 | 1 | <1 | 13 | 12 | 26 |
| YCS9706 | 61 | 34 | — | — | — | 34 |
| YCS9707 | 63 | 8 | — | 9 | 11 | 29 |
| YCS9708 | 61 | 6 | 2 | 22 | 1 | 32 |
| YCS9709 | 66 | 1 | — | 12 | 13 | 25 |
| YCS9710 | 65 | 1 | 1 | 13 | 12 | 26 |
| YCS9711 | 60 | 35 | <1 | — | — | 35 |
| YCS9712 | 55 | 35 | — | — | — | 35 |
| YCS9713 | 59 | 36 | — | — | — | 36 |
| YCS9714 | 59 | 34 | — | — | — | 34 |
| YCS9715 | 59 | 34 | — | — | — | 36 |
| YCS9165 | 54 | 37 | — | — | — | 37 |
| YCS9801 | 58 | 37 | — | — | — | 36 |
| YCS9802 | 63 | 29 | — | — | — | 29 |
| YCS9803 | 64 | 29 | — | — | — | 29 |
| YCS9804 | 64 | 29 | — | — | — | 29 |
| YCS9805 | 64 | 28 | — | — | — | 28 |
| YCS9806 | 57 | 1 | 1 | 14 | 18 | 34 |
| YCS9807 | 61 | 5 | 2 | 23 | 2 | 32 |
| YCS9808 | 59 | 3 | 1 | 19 | 9 | 32 |
| YCS9809 | 59 | 2 | 1 | 18 | 11 | 32 |
| YCS9810 | 61 | 30 | — | — | — | 30 |
| YCS9811 | 58 | 1 | <1 | 15 | 16 | 33 |
| YCS9812 | 46 | 13 | 5 | 27 | 1 | 45 |
| YCS9813 | 61 | 30 | — | — | — | 30 |
| YCS9814 | 57 | 1 | 1 | 15 | 17 | 34 |
| YCS9815 | 58 | 33 | — | — | — | 33 |
| YCS9169 | 56 | 35 | — | — | — | 35 |
| YCS9901 | 49 | 42 | — | — | — | 42 |
| YCS9902 | 52 | 40 | — | — | — | 40 |
| YCS9903 | 54 | 38 | — | — | — | 38 |
| YCS9904 | 66 | 1 | 8 | 16 | — | 24 |
| YCS9905 | 55 | 15 | 6 | 15 | — | 36 |

TABLE 37-continued

% Astaxanthin And Adonixanthin Produced By The YCS9700, YSC9800 and YCS9900 Series Strains

| Strain | Lycopene + β-carotene (%) | Canthaxanthin (%) | Adonirubin (%) | Astaxanthin (%) | Adonixanthin (%) | Carotenoids past β-carotene (%) |
|---|---|---|---|---|---|---|
| YCS9906 | 38 | 14 | 6 | 30 | 4 | 54 |
| YCS9907 | 57 | 35 | — | — | — | 35 |
| YCS9908 | 51 | 11 | 5 | 23 | 3 | 42 |
| YCS9909 | 67 | 1 | — | 8 | 16 | 24 |
| YCS9910 | 57 | 10 | 1 | 15 | 8 | 34 |
| YCS9911 | 70 | 1 | 8 | 11 | — | 20 |
| YCS9912 | 56 | 35 | — | — | — | 35 |
| YCS9913 | 55 | 37 | — | — | — | 37 |
| YCS9914 | 52 | 39 | — | <1 | — | 40 |
| YCS9915 | 60 | 10 | — | 9 | 11 | 31 |

Example 14

Quantification of Carotenoids and PUFAs in *Yarrowia lipolytica* Strains of the YCS8600, YCS8700 and YCS9100 Series Although carotenoids were previously quantified upon isolation of strain YCS8601 (of the YCS8600 strain series; Example 8), strains YCS8734, YCS8740 and YCS8747 (of the YCS8700 strain series; Example 10) and strain YCS9165 and YCS9169 (of the YCS9100 strain series; Example 12), based on the % lycopene, β-carotene, or canthaxanthin produced (with respect to the total carotenoids), more qualitative quantification of carotenoid production had not been performed. Nor had the ω-3 and/or ω-6 PUFA content of the strains been measured, although it was assumed that PUFAs were being produced based on the PUFA biosynthetic pathway that had been engineered in the parent strain of the lineage, Y4184 (31% EPA; Example 7).

In the present Example, each of the aforementioned strains was subjected to analysis, using methodology previously described in the General Methods and Example 2, respectively, to enable quantification of: 1.) the total fatty acid methyl esters (FAME), measured as a percent of the dcw; and, 2.) the lycopene/β-carotene/canthaxanthin concentration, measured in parts per million (ppm). The following exceptions were made to the Example 2 protocol for determination of carotenoid titers in the selected *Yarrowia lipolytica* strains listed in Table 38. Specifically, the size of the glass beads used were 0.5 mm; and, prior to loading the samples onto the HPLC, the samples were dissolved completely into 135 µL chloroform followed by the addition of 2855 µL n-hexane (HPLC-grade) for a final sample volume of 3 mL. Data are summarized below.

TABLE 38

Quantification Of PUFAs And Carotenoid Titer In Select *Yarrowia lipolytica* Strains

| Strain | FAME as % DCW | Lycopene (ppm) | Lycopene/β-carotene (ppm) | Canthaxanthin (ppm) | Total carotenoid (ppm) |
|---|---|---|---|---|---|
| Y4184 | 15.3% | — | — | — | 0 |
| YCS8601 | 6.4% | 1088 | — | — | 1088 |
| YCS8734 | 10.1% | — | 528 | — | 528 |
| YCS8740 | 10.1% | — | 521 | — | 521 |
| YCS8747 | 10.0% | — | 608 | — | 608 |
| YCS9165 | 7.0% | — | — | 293 | 479 |
| YCS9169 | 9.8% | — | — | 340 | 494 |

Example 15

Coenzyme Q Pathway and Profile in Wildtype *Yarrowia lipolytica*

The present Example describes the quantification of $CoQ_9$ in wildtype *Yarrowia lipolytica*. Specifically, determination of the amount of $CoQ_9$ in *Yarrowia lipolytica* strain ATCC #20362 was made using an Agilent series 1100 HPLC equipped with a DAD detector. The sample was generated by extracting the oil in 3:1 hexane:methanol overnight, partitioning the solvents using a 1 N NaCl solution and stripping the hexane with a Büchi® Rotavapor® (New Castle, Del.).

Three samples of approximately 15, 38, and 86 mg were added to a 4 mL amber vial. Then, 100 µL of glass beads and 1.0 mL of a previously sparged 1:1 tetrahydrofuran (THF)/methanol (MeOH) solution were added and shaken for 15 min at 200 rpm. The sample was then transferred to a Whatman uni-prep vial and analyzed.

A 1 mg standard sample of $CoQ_9$ received from Fluka Chemical Corp. (Milwaukee, Wis.; Catalog #27597, lot #378472) was diluted to 0.1 mg using 1:1 THF/MeOH and analyzed. The standard received was assumed to be exactly 1 mg.

The HPLC conditions used were as follows: Zorbax SB-C18 4.6×250 mm column, 5 micron; 1.0 mL/min flow rate; 35° C. column temperature; 5 µL injection volume; UV detection at 270 and 450 nm wavelengths.

TABLE 39

HPLC Solvents/Gradients For $CoQ_9$ Extraction

| Time (min) | Solvent A: Acetonitrile | Solvent B: Isopropanol |
|---|---|---|
| 0.0 | 95% | 5% |
| 30.0 | 0% | 100% |
| 35.0 | 0% | 100% |
| 36.0 | 95% | 5% |
| 45.0 | 95% | 5% |

Calculations were performed as follows. Specifically, the standard reference factor was equivalent to the milligrams (mg) of standard/area. The percent (%) sample amount was determined according to the following formula: standard reference factor*(sample peak area/sample concentration)*100. The ratio of the sample against the standard was calculated and the sample weight taken into account. The sample used was 26.64 mg and diluted with 1 mL of MeOH/THF that had been sparged of air. This was run against the existing standard of 0.1 mg/mL of $CoQ_9$. The area counts for the standard were 18.9 at 450 nm and 711 at 270 nm, while for the sample, the area counts were 13 at 450 nm and 569 at 270 nm. Based on these results, the $CoQ_9$ calculated in the oil was in the range of 0.2 to 0.3%.

SEQUENCE LISTING (99 sequences)

SEQ ID NO: 1 - DNA, 2987 bp, Yarrowia lipolytica
  misc_feature: mutant acetohydroxyacid synthase (AHAS) with W497L mutation
  ref <302>: TITLE: HIGH EICOSAPENTAENOIC ACID PRODUCING STRAINS OF YARROWIA LIPOLYTICA
  ref <310>: PATENT DOCUMENT NUMBER: US 2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(2987)
  ref <302>: TITLE: HIGH EICOSAPENTAENOIC ACID PRODUCING STRAINS OF YARROWIA LIPOLYTICA
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(2987)
ttccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctc

SEQ ID NO: 2 - DNA, 911 bp, Pantoea stewartii DC413
  CDS (1)..(909): synthetic geranylgeranyl pyrophosphate synthase (crtE) (codon-optimized for Yarrowia lipolytica)
atggctatcttcgctgagagagactccactctcatctactctgatcctctgatgctccttgccatcattgagcagcgtctcgaccgacttctgcctgtcgaatccgagcgagactgcgttggtctcgccatgcgagaaggcgctttggcacccggaaagcgaatcagacctgtccttctcatgctggctgcccacgaccttggctaccgagacgaactctctggacttctcgacttcgcctgtgctgtcgagatggttcacgcagcctccctgatcctggatgacattccctgcatggacgatgccgagcttcgacgtggccgacctaccatccatcgacagttcggtgaacccgtggctatcctcgcagccgttgctctgctttcacgagccttcggagtcattgctctggcagacggcatctcttcccaggccaagactcaggccgtggctgagcttagccactccgtcggtattcagggtctggttcaaggacagtttctcgatctgaccgaaggaggtcaaccacgatccgctgatgccattcagcttaccaaccacttcaagacttctgccctgttttcggctgccatgcagatggctgccatcattgctggtgctcctctggcatcccgagagaagttgcatcgtttcgctcgagacctcggacaagcctttcagctgctcgacgatctgacagacggccagagcgacactggcaaggatgcccatcaggacgtcggaaagtctaccctggtcaacatgttgggttccaaagcagtcgagaagcgactgagagaccacttgcgacgtgccgatcgacatctcgcttctgcctgtgactccggatacgccacccgacactttgtgcaggcttggttcgacaaaaagctcgcaatggtcggttaagc

SEQ ID NO: 3 - protein, 302 aa, Pantoea stewartii DC413
MAIFAERDSTLIYSDPLMLLAIIEQRLDRLLPVESERDCVGLAMREGALAPGKRIRPVLLMLAAHDLGYRDELSGLLDFACAVEMVHAASLILDDIPCMDDAELRRGRPTIHRQFGEPVAILAAVALLSRAFGVIALADGISSQAKTQAVAELSHSVGIQGLVQGQFLDLTEGGQPRSADAIQLTNHFKTSALFSAAMQMAAIIAGAPLASREKLHRFARDLGQAFQLLDDLTDGQSDTGKDAHQDVGKSTLVNMLGSKAVEKRLRDHLRRADRHLASACDSGYATRHFVQAWFDKKLAMVG

SEQ ID NO: 4 - DNA, 936 bp, Pantoea stewartii DC413
  CDS (1)..(936): synthetic phytoene synthase (crtB) (codon-optimized for Yarrowia lipolytica)
atggacaaccctactctcctgcaccatgctgtcgagactatggaggttggatccaagtcgttcgctaccgcttccaagctctttgacgccaagactcgacgttctgtcctgatgctctacgcttggtgtcgacactgtgacgatgtcatcgacgatcagcaactcggctttcctggtgaggttccctctgcacagacacctcaacagcgacttgctaacctcgaacgaaagactcgacaggcctacgctggagctcagatgcacgaacctgccttcgctgccttccaggaggttgccattgctcacgacatctctccagcatacgccttcgatcatctcgaaggctttgctatggacgttcgaggtgctagatacgagaccttccaggacactctgcgatactgttaccacgttgctggagtcgttggtctcatgatggctcagatcatgggagttcgagacgaagccgtgctggatcgagcttgtgacctcggtctggcctttcagcttaccaacattgctcgagacattgtcgaggatgcacgagttggacgttgctacctgcctgagtcctggctcgaggaagctggactcgatcgactgcacttcgctgacagagcccatcgacctgctcttgccaacttggcacgaagactcgtctccgaggctgaaccctactatgcctctgccagcgctggcctcgcaggtcttcccttgcgatctgcctgggctattgcaactgccaaggaagtctacagacgaatcggagtgaaggtttacggtgctggcgagactgcctgggacagacgacagtctacctcgaagcaggagaagctcctgcttctggctgcaggagctgcccaagctatccgatcccgtgccgctgcatctcctccacgacctgcagagttgtggcagcgacctcgttaagcggcc

SEQ ID NO: 5 - protein, 309 aa, Pantoea stewartii DC413
MDNPTLLHHAVETMEVGSKSFATASKLFDAKTRRSVLMLYAWCRHCDDVIDDQQLGFPGEVPSAQTPQQRLANLERKTRQAYAGAQMHEPAFAAFQEVAIAHDISPAYAFDHLEGFAMDVRGARYETFQDTLRYCYHVAGVVGLMMAQIMGVRDEAVLDRACDLGLAFQLTNIARDIVEDARVGRCYLPESWLEEAGLDRLHFADRAHRPALANLARRLVSEAEPYYASASAGLAGLPLRSAWAIATAKEVYRRIGVKVYGAGETAWDRRQSTSKQEKLLLLAAGAAQAIRSRAAASPPRPAELWQRPR

SEQ ID NO: 6 - DNA, 1484 bp, Pantoea stewartii DC413
  CDS (1)..(1482): synthetic phytoene desaturase (crtI) (codon-optimized for Yarrowia lipolytica)
atggctcacaccactgtcatcggagctggctttggtggactggctctcgccattcgactgcaggctgcaggcgttcccacccgacttctggagcagcgagacaagcctggtggcagagcctacgtgtaccaggaccaaggcttcacctttgatgctggacccactgtcattaccgatccctccgccatcgaagagctcttcgctcttgccggcaagtccatgcgagactacgttgagctgcttcccgttacccctttctaccgactctgctgggagactggcgaggtctttaactacgataacgatcaggctcgactggaagccgagattcggaagttcaatcctgccgacgtggctggctatcagcgattcctcgactactctcgagccgtcttcgcagaaggttacctcaagttgggaaccgttccctttctgtcctttcgagacatgcttcgagccgctcctcagctcgcacgtcttcaggcttggcgatctgtctactccaaggtggccagcttcattgaggatgacaagctgagacaagccttctcctttcactcgttgctcgttggtggcaacccattcgctacttcctctatctacaccctgattcatgcattggagcgagaatggggtgtctggtttcctcgaggtggcacaggagctctggttcagggtatgctcaagctgttccaggacttgggtggaaccctggagctcaacgccagagtctctcacatcgaggccaaggaggctgccatttccgcagtgcacttggaggatggtcgagtcttcgaaactcgagctgttgcctccaacgccgacgtggttcatacctatggcgatcttctcggaagacatcccgctgcagccgctcaggccaaaaagctgaagggcaagcgaatgtcgaactccttgtttgtcctctacttcggactgaaccaccatcacgaccagcttgctcatcacaccgtctgcttcggtcctcgataccgtgagctcattgacgaaatcttcaaccgagatggacttgccgaagacttctctctctaccttcatgctccctgtgtgactgatccctcgcttgcacctcccggatgtggcagctactatgtcctggctcccgttcctcaccttggtacagccgatctcgactggaacgtcgagggtcctcgactgagagaccgaatctttgcctatctcgaagagcactacatgcctggactgcgatctcaactggttactcatcgaatcttcactcccttcgactttcgagatcagctcaatgcctaccaaggttccgcattctcggtggagcccatcttgagacagtctgcttggtttcgacctcacaaccgagactcgcacattcggaatctctatctggtcggtgccggaacccatcccggtgctggcattcctggagtgatcggttctgccaaggctactgcctccctgatgctcgaggatctgcacgcctaagc

SEQ ID NO: 7 - protein, 493 aa, Pantoea stewartii DC413
MAHTTVIGAGFGGLALAIRLQAAGVPTRLLEQRDKPGGRAYVYQDQGFTFDAGPTVITDPSAIEELFALAGKSMRDYVELLPVTPFYRLCWETGEVFNYDNDQARLEAEIRKFNPADVAGYQRFLDYSRAVFAEGYLKLGTVPFLSFRDMLRAAPQLARLQAWRSVYSKVASFIEDDKLRQAFSFHSLLVGGNPFATSSIYTLIHALEREWGVWFPRGGTGALVQGMLKLFQDLGGTLELNARVSHIEAKEAAISAVHLEDGRVFETRAVASNADVVHTYGDLLGRHPAAAAQAKKLKGKRMSNSLFVLYFGLNHHHDQLAHHTVCFGPRYRELIDEIFNRDGLAEDFSLYLHAPCVTDPSLAPPGCGSYYVLAPVPHLGTADLDWNVEGPRLRDRIFAYLEEHYMPGLRSQLVTHRIFTPFDFRDQLNAYQGSAFSVEPILRQSAWFRPHNRDSHIRNLYLVGAGTHPGAGIPGVIGSAKATASLMLEDLHA

SEQ ID NO: 8 - DNA, 11337 bp, artificial sequence
  Plasmid pZKleuN-6EP
cgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttactggagctttctggccttctccttggcagcgtcagccttggcctgcttggcgagcttggcgttctttcggtaaaagttgtagaagagaccgagcatggtccacatgtagaaccagagcagagcggtgatgaagaaggggtatccaggtcggccaaggaccttcatggcgtacatgtcccaggaagactggacagacatcatgcagaactgggtcatctgggatcgagtgatgtagaacttgatgaacgacacctgcttgaagcccagggcagacagaaagtagtagccgtacatgatgacgtggatgaaggagttcagggcagcagagaagtaggcttcaccgttgggagcaacgaaggtgaccagccaccagatggtgaagatggaagagtggtggtacacgtgcagaaaggaaatctgtcggttgttcttcttgaggaccatgatcatggtgtcgacaaactccatgatcttggagaagtagaagagccagatcatcttagccatagggagacccttgaaggtgtgatcggcagcgttctcaaacagtccatagttggcctgataagcctcgtacaggatgccaccgcacatgtaggcggagatggagaccagacagaagttgtgcaggagggagaaggtcttgacctcgaatcgttcaaagttcttcatgatctgcatacccacaaacacggtgaccaggtaggcgagcacgatcaggagcacgtggaaggggttcatcagaggcagctctcgagccaggggagactccacggcaaccaggaagcctcgagtgtgatggacaatggtgggaatgtacttctcggcctgggcaaccagggcagcctccaggggatcgacgtagggagcagctcggacaccgatagcgctggcgaggtccatgaacaggtcctgaggcatcttggagggcaggaagggagcaatggactccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgccgctccctctgtgcgaacctttacccgagccgaggttctgaacgctgaggctctgaacgagggcaagaaggacgctgaggctcccttcctgatgatcatcgacaacaaggtgtacgacgtccgagagttcgtccctgaccatcctggaggctccgtgattctcacccacgttggcaaggacggcaccgacgtctttgacacctttcatcccgaggctgcttgggagactctcgccaacttctacgttggagacattgacgagtccgaccgagacatcaagaacgatgactttgccgctgaggtccgaaagctgcgaaccctgttccagtctctcggctactacgactcctctaaggcctactacgccttcaaggtctccttcaacctctgcatctggggactgtccaccgtcattgtggccaagtggggtcagacctccaccctcgccaacgtgctctctgctgccctgctcggcctgttctggcagcagtgcggatggctggctcacgactttctgcaccaccaggtcttccaggaccgattctggggtgatctcttcggagccttcctgggaggtgtctgccagggcttctcctcttcctggtggaaggacaagcacaacactcaccatgccgctcccaacgtgcatggcgaggatcctgacattgacacccaccctctcctgacctggtccgagcacgctctggagatgttctccgacgtccccgatgaggagctgacccgaatgtggtctcgattcatggtcctgaaccagacctggttctacttccccattctctccttcgctcgactgtcttggtgcctccagtccattctctttgtgctgcccaacggtcaggctcacaagccctccggagctcgagtgcccatctccctggtcgagcagctgtccctcgccatgcactggacctggtacctcgctaccatgttcctgttcatcaaggatcctgtcaacatgctcgtgtacttcctggtgtctcaggctgtgtgcggaaacctgctcgccatcgtgttctccctcaaccacaacggtatgcctgtgatctccaaggaggaggctgtcgacatggatttctttaccaagcagatcatcactggtcgagatgtccatcctggactgttcgccaactggttcaccggtggcctgaactaccagatcgagcatcacctgttcccttccatgcctcgacacaacttctccaagatccagcctgccgtcgagaccctgtgcaagaagtacaacgtccgataccacaccactggtatgatcgagggaactgccgaggtcttctcccgactgaacgaggtctccaaggccacctccaagatgggcaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttactgtatattcggtaagatatattttgtggggttttagtggtgtttggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttaattaactttggccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaat

SEQ ID NO: 9 - DNA, 34 bp, Escherichia coli
ataacttcgtataatgtatgctatacgaagttat

SEQ ID NO: 10 - DNA, 6874 bp, artificial sequence
  Plasmid pEXPGUS1-P
aattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgtcgagggagtttggcgcccgttttttcgagccccacacgtttcggtgagtatgagcggcggcagattcgagcgtttccggtttccgcggctggacgagagcccatgatgggggctcccaccaccagcaatcagggccctgattacacacccacctgtaatgtcatgctgtttaaacatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccgggatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgattaattaactagagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcg

SEQ ID NO: 11 - DNA, 11444 bp, artificial sequence
  Plasmid pZP34R
cgatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggttcgatccgagtacgccgacgttcctcccgtcgacctgcccattcacgatgctgtgctcggaggtgctgccgctttcggctctactcctgccctgatcgacggaaccgacggcaccactctcacctacgagcaggtggaccgatttcacagacgagtcgctgcagcccttgccgagacaggcgttcgaaagggagacgtcttggctctgcactctcccaacactgttgccttcccacttgccttctacgctgccaccagagctggtgcctccgtcaccactgtgcatcctcttgctacagcagaagagtttgccaagcagctgaaggactctgctgcccgatggattgtcaccgtttcccctctcctgtccactgcccgacgagctgccgagcttgctggaggcgtccaggagattctggtttgcgacagcgcacccggtcaccgatcccttgtcgatatgctggcctctacagctcccgaaccttccgtcgccatcgaccctgcagaggacgttgctgccttgccctactcttccggaactaccggtactcccaagggtgtcatgctcacccatcgacagattgccaccaacctggctcaactcgaaccttccatgccctctgctcctggagatcgagttcttgcagtgcttcccttctttcacatctatggtctgactgccctcatgaacgctcctctgcgactcggagccaccgtcgtggttcttccacgattcgacctggagcagtttctcgctgccattcagaaccaccgaatcacttcgctgtacgtcgctcctcccattgtgctggcacttgccaaacatcccttggttgccgactacgatctctcctcgctgagatacatcgtgtcggctgccgcacctctcgatgctcgacttgccgctgcctgttcccagcgactcggactgcctcccgtcggtcaggcttacggcatgaccgagctgtctcctggaacacacgtggttcccttggacgcaatggccgatgctcctcctggcactgtcggtcgactcattgccggaaccgagatgcgaatcgtctccctcaccgatccaggtacagaccttcctgctggagagtctggcgagattctcattcgaggtccccagatcatgaagggctacttgggaagacccgatgccactgctgccatgatcgacgaagaaggctggctgcacacaggtgatgtcggacacgtggatgccgatggctggctgtttgttgtcgaccgagtcaaggagcttatcaagtacaagggattccaggttgctcctgccgagctggaagcccacctgctcactcatccaggtgtcgcagacgctgccgtggttggagcctacgacgatgacggcaacgaggttccccatgccttcgtcgtgcgacaacctgccgctcccggtcttgccgagtccgagatcatgatgtacgttgccgaacgagtcgctccctacaagcgagtgcgacgagttaccttcgtcgatgccgttcccagagctgcctccggcaagattctccgaagacagctgcgagagcctcgataagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacggtgtgtatcgtagaggtagtgacgtgttgtccacagggcgactgtgtccgtgtatatatatattcctcggcccgagcttatttgtgtggggttgaggaaatcaaaccaaatcggtagtcagagaaataaaacaaaaagaaataaaaagaaatagaggacgcacaacgccatcaccgtcggagagacaggagaagggaaaatgggcaaaaatgcccttatcacacccgcccgctttgtgctctcattcggctcccacaagagcctcttgtcctggttccccccccccacattttaacaccccacacgacgttgctgcacgtggaattttcggccgaaaacctgtggggtacttacttttggcactggagagaagcatctgggattttgggaacctaggcagaagatgaggaaaaaaataagaggaaccgttgtgagcttgcttatcagtgtcatatactcccccctccttgcgtttttgcgtcttttccccctatttttcaaattttgcgattttttttctctttttttccgcttttttccgctttttttttggccggcttttatccatttctccaagccgaggatcacatctatgcagcccagtccgttggagcatatctgcggtagagtttcggaacggcgttaagcactgtgtccgggtcggtctggaacgagattgagcgggaaattcgggggaataagaccaccgttggactccccgcaatgaggagatcaagatgtgcttttcagaattctgattggtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgtcgagatatcgacattgttccatctccagtttaaccccaacttatcgagagtatttgtgagacacgcaataaatgaatttataccaatcaaatccatattctacgctgtctacatatagatactttttgtcatctcttgccctactatttcgtcgatatatgaaggatacgccaaccgaacccatactccacgctacacacgcgccttttcacgcatttctggggaaaatagacacccttggtgtcacctgaagaatatgaaagaagatattcattgtattgagctgtagatctgtgtatttcttgacctcatcaatgacttctgggctctttacctcgaatcatggtggtactgtaccacatctcaacaccttgtagcacacctatgggaaaattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatctattcctcgtccagctcgcaaatgtcgtcatcttaattaagttgcgacacatgtcttgatagtatcttggcttctctctcttgagcttttccataacaagttcttctgcctccaggaagtccatggtgaatgattcttatactcagaaggaaatgcttaacgatttcgggtgtgagttgacaaggagagagagaaaagaagaggaaaggtaattcggggacggtggtcttttatacccttggctaaagtcccaaccacaaagcaaaaaaattttcagtagtctattttgcgtccggcatgggttacccggatggccagacaaagaaactagtacaaagtctgaacaagcgtagattccagactgcagtaccctacgcccttaacggcaagtgtgggaaccgggggaggtttgatatgtggggtgaagggggctctcgccggggttgggcccgctactgggtcaatttggggtcaattggggcaattggggctgttttttgggacacaaatacgccgccaacccggtctctcctgaattctgcagatgggctgcaggaattccgtcgtcgcctgagtcgacatcatttaaataccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaattcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttagatctgtatattcggtaagatatattttgtggggttttagtggtgtttaaacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttagttagtgacggtgggaacagagtggagcacgacagtttcgatggtcagtccaggaccaaagccgaagaggactccccagtccaggccttcaccagtggtggccttctctcccttgagggatttctttcgcatctcgtccagaatgaagagcacacaagcagaggacatgttgccgtactcgctcagcacgtgtcgagtggcttcgagcttcttcttctccaggttgagcttagcctcaactgcgtcgaggatggcaggacctccgggatgagcaatccagaacagagagttccagtcggagataccgagagggtcgaaagcctgggtcaggcacttctcaatgttctcggagatgagagtgggcacattaggccacaggtggaaggtgaggccaacctctcgcaggtttccggcaatggcaccagcagagttggggataaaggtttgggcagcggagacaagctggaagaggggtcgctcgatagagacatcgggatcggatccaacaatcacggcagaggagccatcaccaaacagagcctggccgacgagggagtccagggcatcttcagagggacctcggaaggtcacgacagtgatttcggagcacacaacgaggactcgtgctccagcgttgttctcggccaggtccttggcagttcggagcacggtgccaccagcgtagcagccttggtggtacagcatgactcgtcggacggaggtttcaaggccgagcaggttagcgagcttgtagtcggctccaggcatttccacaccagaggtagtacagaagaccagatgggtgatcttggacttgggctgtccccactctttgagagccttcagggcagcatcccgaccgagtcggggaacctcagcggtgataatctcctgtcggatgttcagagaaggagccatgtaagcgccaatgttgggatgctcttcgagcatctcttcagtcaggtggatgtatcgcttcttaatcatggatttgtcacagatccggttgaacttcttcttgagctcggtcatgtgctcggacttggtcactcggaagtagtaatcggcatagtcagactggtagacacagtggtcaggggtagcagtgccaatggccaggatggtagcgggacccttggctcgctgagcgtttcggaattcctcaacggaggccatggtgaatgattcttatactcagaaggaaatgcttaacgatttcgggtgtgagttgacaaggagagagagaaaagaagaggaaaggtaattcggggacggtggtcttttatacccttggctaaagtcccaaccacaaagcaaaaaaattttcagtagtctattttgcgtccggcatgggttacccggatggccagacaaagaaactagtacaaagtctgaacaagcgtagattccagactgcagtaccctacgcccttaacggcaagtgtgggaaccgggggaggtttgatatgtggggtgaagggggctctcgccggggttgggcccgctactgggtcaatttggggtcaattggggcaattggggctgttttttgggacacaaatacgccgccaacccggtctctcctgaattctgcat

SEQ ID NO: 12 - DNA, 13489 bp, artificial sequence
  Plasmid pYCRTEBI
gatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctatcttcgctgagagagactccactctcatctactctgatcctctgatgctccttgccatcattgagcagcgtctcgaccgacttctgcctgtcgaatccgagcgagactgcgttggtctcgccatgcgagaaggcgctttggcacccggaaagcgaatcagacctgtccttctcatgctggctgcccacgaccttggctaccgagacgaactctctggacttctcgacttcgcctgtgctgtcgagatggttcacgcagcctccctgatcctggatgacattccctgcatggacgatgccgagcttcgacgtggccgacctaccatccatcgacagttcggtgaacccgtggctatcctcgcagccgttgctctgctttcacgagccttcggagtcattgctctggcagacggcatctcttcccaggccaagactcaggccgtggctgagcttagccactccgtcggtattcagggtctggttcaaggacagtttctcgatctgaccgaaggaggtcaaccacgatccgctgatgccattcagcttaccaaccacttcaagacttctgccctgttttcggctgccatgcagatggctgccatcattgctggtgctcctctggcatcccgagagaagttgcatcgtttcgctcgagacctcggacaagcctttcagctgctcgacgatctgacagacggccagagcgacactggcaaggatgcccatcaggacgtcggaaagtctaccctggtcaacatgttgggttccaaagcagtcgagaagcgactgagagaccacttgcgacgtgccgatcgacatctcgcttctgcctgtgactccggatacgccacccgacactttgtgcaggcttggttcgacaaaaagctcgcaatggtcggttaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttactgtatattcggtaagatatattttgtggggttttagtggtgtttggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttaattaactttggccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaacgaggtcgctgccacaactctgcaggtcgtggaggagatgcagcggcacgggatcggatagcttgggcagctcctgcagccagaagcaggagcttctcctgcttcgaggtagactgtcgtctgtcccaggcagtctcgccagcaccgtaaaccttcactccgattcgtctgtagacttccttggcagttgcaatagcccaggcagatcgcaagggaagacctgcgaggccagcgctggcagaggcatagtagggttcagcctcggagacgagtcttcgtgccaagttggcaagagcaggtcgatgggctctgtcagcgaagtgcagtcgatcgagtccagcttcctcgagccaggactcaggcaggtagcaacgtccaactcgtgcatcctcgacaatgtctcgagcaatgttggtaagctgaaaggccagaccgaggtcacaagctcgatccagcacggcttcgtctcgaactcccatgatctgagccatcatgagaccaacgactccagcaacgtggtaacagtatcgcagagtgtcctggaaggtctcgtatctagcacctcgaacgtccatagcaaagccttcgagatgatcgaaggcgtatgctggagagatgtcgtgagcaatggcaacctcctggaaggcagcgaaggcaggttcgtgcatctgagctccagcgtaggcctgtcgagtctttcgttcgaggttagcaagtcgctgttgaggtgtctgtgcagagggaacctcaccaggaaagccgagttgctgatcgtcgatgacatcgtcacagtgtcgacaccaagcgtagagcatcaggacagaacgtcgagtcttggcgtcaaagagcttggaagcggtagcgaacgacttggatccaacctccatagtctcgacagcatggtgcaggagagtagggttgtccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggctcacaccactgtcatcggagctggctttggtggactggctctcgccattcgactgcaggctgcaggcgttcccacccgacttctggagcagcgagacaagcctggtggcagagcctacgtgtaccaggaccaaggcttcacctttgatgctggacccactgtcattaccgatccctccgccatcgaagagctcttcgctcttgccggcaagtccatgcgagactacgttgagctgcttcccgttacccctttctaccgactctgctgggagactggcgaggtctttaactacgataacgatcaggctcgactggaagccgagattcggaagttcaatcctgccgacgtggctggctatcagcgattcctcgactactctcgagccgtcttcgcagaaggttacctcaagttgggaaccgttccctttctgtcctttcgagacatgcttcgagccgctcctcagctcgcacgtcttcaggcttggcgatctgtctactccaaggtggccagcttcattgaggatgacaagctgagacaagccttctcctttcactcgttgctcgttggtggcaacccattcgctacttcctctatctacaccctgattcatgcattggagcgagaatggggtgtctggtttcctcgaggtggcacaggagctctggttcagggtatgctcaagctgttccaggacttgggtggaaccctggagctcaacgccagagtctctcacatcgaggccaaggaggctgccatttccgcagtgcacttggaggatggtcgagtcttcgaaactcgagctgttgcctccaacgccgacgtggttcatacctatggcgatcttctcggaagacatcccgctgcagccgctcaggccaaaaagctgaagggcaagcgaatgtcgaactccttgtttgtcctctacttcggactgaaccaccatcacgaccagcttgctcatcacaccgtctgcttcggtcctcgataccgtgagctcattgacgaaatcttcaaccgagatggacttgccgaagacttctctctctaccttcatgctccctgtgtgactgatccctcgcttgcacctcccggatgtggcagctactatgtcctggctcccgttcctcaccttggtacagccgatctcgactggaacgtcgagggtcctcgactgagagaccgaatctttgcctatctcgaagagcactacatgcctggactgcgatctcaactggttactcatcgaatcttcactcccttcgactttcgagatcagctcaatgcctaccaaggttccgcattctcggtggagcccatcttgagacagtctgcttggtttcgacctcacaaccgagactcgcacattcggaatctctatctggtcggtgccggaacccatcccggtgctggcattcctggagtgatcggttctgccaaggctactgcctccctgatgctcgaggatctgcacgcctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacaccactaaaaccccacaaaatatatcttaccgaatataca

SEQ ID NO: 13 - DNA, 8982 bp, Artificial Sequence
  Plasmid pY79
ggtggagctccagcttttgttccctttagtgagggttaatttcgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaattaattaattccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctcgtcgactcaggcgacgacggaattcctgcagcccatctgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatgtccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaaggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgc

SEQ ID NO: 14 - DNA, 14256 bp, artificial sequence
  Plasmid pZKLS555
cgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcgacagcaactactcctttcaccaaccatgtgcattttagctcgaataacattcacaggcttggtgatctacatccatggtgtctggccgattaccgtggtgttttggcagtaacgagaatattgagtgaactcttcccatcaccaataaagactcatactacaatcacgagcgcttcagctgccactatagtgttggtgacacaatacccctcgatgctgggcattactgtagcaagagatattcatttcatggcgcattttccagtctacctgactttttagtgccgatttcttctccacattttacgctcagtgtgaaaagttggagtcgacttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgttatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggtcgctggcaagtccggagctgcagcccacgtgacccactcttccactctccctcgagagtaccacggtgctaccaacgactcccgatctgaggctgccgatgtcaccgtctcgtctatcgacgccgagaaggagatgattatcaacggacgagtgtacgacgtctcctcgttcgtgaagcgacaccctggtggctccgtcatcaagttccagctcggagcagatgcttctgacgcttacaacaacttccacgtccgatcgaagaaggctgacaagatgctgtactctcttccctcccgacctgccgaggctggctatgcacaggacgacatctctagagactttgagaagctgcgactggaactgaaagaggaaggttacttcgagcccaatctggtgcacgtgtcctaccgatgtgtcgaggtgcttgccatgtactgggctggcgtccagctgatctggtccggatactggttcctcggtgccatcgttgctggaattgctcaaggtcgatgcggatggctccagcatgaaggcggacactactcgctcactggcaacatcaagattgaccgacatctccagatggccatctatggactgggctgtggtatgtctggctgctactggagaaaccagcacaacaaacatcacgccactcctcagaagctcggaaccgatcccgacctgcagaccatgcctctcgttgccttccacaagattgtcggagccaaggcacgaggcaagggtaaagcctggcttgcttggcaagctcccctcttctttggaggcatcatttgctccctggtctctttcggctggcagttcgttctccaccccaatcatgcactgcgagtgcacaaccatctcgaactggcctacatgggtctccgatacgttctctggcaccttgcctttggccatctgggactcctgtcctctcttcgactgtatgccttctacgtggctgtcggtggcacctacatcttcaccaacttcgccgtctcccatactcacaaggatgtcgttcctcccaccaagcacatttcgtgggctctgtactctgccaaccacactaccaactgttccgactctccctttgtcaactggtggatggcctacctcaacttccagatcgagcaccatctgttcccctccatgcctcagtacaaccaccccaagattgctcctcgagtgcgagcactcttcgagaagcacggagtcgagtacgacgtccgaccctatctggaatgctttcgagtgacctacgtcaacctccttgctgttggcaaccctgagcactcctaccacgagcatactcactaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttgacaatggatggtgtgtcgtatcaggctggggaacaattgtgcttaagtatgctgcagttgagtaagagtcatcgctccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaacctcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccat

SEQ ID NO: 15 - DNA, 12210 bp, artificial sequence
  Plasmid pDCQ392
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattcactagttaacgcggacgctgccagagctcggcaggacgcggcggagaagcagccgcccgagacctgatcgcctgcgccgcccccgccgccagcagcagaagcttctcctgcttgctggtggactggcggcgatcccaggccgtttcccccgcgccgtagaccttaaccccaatgcggcgataaacctctttcgccgtggcgatcgcccacgcagagcgcagcggcagcccggccagcccggccgacgcagaggcgtagtagggctccgcctcgctcaccagccgccgcgccagattcgccagcgccgggcgatgagcgcgatcggcaaagtgaagacgatccagcccggcctcctccagccagctttccggcaaatagcagcggccgactcgcgcatcctcaacgatatcgcgtgcaatattggtcagctgaaaggcgaggccgagatcgcaggcgcgatccagcaccgcctcgtcgcgcacccccataatctgcgccatcattaatcccaccacgcccgccacgtggtagcagtagcgcagcgtatcctgaaaggtttcataacgcgcgccgcggacgtccattgcaaacccttccagatggtcgaaagcgtaagcgggagagatatcgtgggcgatcgccacctcctgaaaggcggcgaaggcgggttcatgcatttgcgcgcccgcgtaggcctggcgggttttgcgctccagatttgccagacgctgctgcggggtctgcgccgaaggaacctcgcctggaaagccaagctgctggtcatcgatcacatcatcacagtggcggcaccaggcgtagagcatcagcacgctgcggcgcgttttcgcgtcgaacagctttgaggcggtggcgaaactcttcgaaccgacttccatcgtctctacggcatggtgcagcagcgtcggattatgcatgcagatcctccagcatcaggcttgcggtggctttggcggaaccgatcacgccgggaatgcccgcgcctgggtgcgtacccgcgccgaccagatagagattgcggatatggctgtcgcggttatggggccggaaccaggcgctctggcgcaaaatcggctcaacggaaaacgcagagccctgataggcattaagctggtcgcggaaatcgaacggcgtgaagatgcggtgagtgaccagctggctgcgcaggccgggcatatagtgctcttcgagataggcgaaaatgcgatcgcgcaggcgcggcccctcaacgttccagtcgagatcggcggtgccaagatggggaaccggtgccagcacgtagtagctgccgcagcccggcggcgccagcgagggatcggtcacgcagggcgcatggagatagagcgagaaatcttccgccagcccgtcgcggttaaagatctcgtcaatcagctcacggtagcgcggcccgaagcagacggtgtggtgcgccagctgatcgtgatgatggttcaggccaaaatagagcacaaacagcgagttgctcatgcgcttgcctttcagctttttggcctgcgcggcggcggcggggtgcctgccgagcagatcgccataggtatgcaccacatcggcgttagaggcgaccgcgcgggtttcaaatacccgaccatcctccagatgcacggcggaaatcgcggcctctttcgcctcgatatggctgacgcgcgcgttcagctccagcgtgccgcctaaatcctggaacagcttcagcatgccctgcaccagcgcgccggtgccgccgcgcggaaaccagacgccccattcgcgctccagcgcgtggatcagcgtatagatcgacgaggtggcgaaggggttgccgccgaccagcagcgagtgaaacgaaaaggcctgccgcagcttatcatcctcgataaagctcgccaccttgctgtaaacgctgcgccacgcctgcaggcgcgccagctgcggtgcggcgcgcagcatatcgcggaacgacaaaaagggcacggtgccgagcttcaggtagccttcggcgaacacggcgcgcgaatagtcgaggaagcgctgatagcccgccacgtcggctggattaaatttgcggatctccgcttccagtcgcgcctgatcgttatcgtagttaaacacctcgcccgtctcccagcagagccggtaaaaaggggtcaccggcagcagctcgacatagtcgcgcatcgattttcccgccagggcgaacagctcttcaatagcggacggatcggtgatcaccgtcgggcccgcgtcaaaggtaaagccctgatcctgataaacataggcgcggccgcccggcttgtcgcgctgctccagcagccgcgttggaacgcctgctgcctggaggcgaattgccagtgccagcccgccaaatcctgcgccaattaccgtggtgtgcttcatcgtgatgctcttcgtccagaagggtgggtgagaatagcctgcagcgccgccagcaccgggaccggcggcttgccgctaagaatgcgcgcgcggtcggccagcgtcagccgtccggcgtaaaaccgggcgatcagcccctcgggcaggccgtaaaagcgctgcattacgcgccagcgccgatcgccctcggccgccaggaacagcatgcggttaagcatgcggaaaaagccctgtttacgccacgctgcctgcgcaaagcggtgaatacgcggcgcgagcgcctcaggggagaagtccgcctctgcggcgagcgcgtccgccagcgtcgccgccagcggcagggagtagccggtcgtggggtgaaaaagcccggcgcgcaggccgacgcagggggcgcgatgatgccagaagcggtcgaaatcgcccgccagcgtaatcggcagcgcgccgcgctcttcgcgcagcagcgtctccagctgccagccctggcgggtggcgtagtcgcagatattctgccgcgcctgcgccgtcgccagcgaggcgtcgttaatatagtgggtatcttcaatcagcagacgcgtcggcgagagcggcagggtatagacgaagcgatagcccccctgctgatccacggccgcgtccatcagaatcggcccctccagctgatgcggctggctcaggcgccactcctgaccgacaaaagactgaaagccaatctgcagggcggcgtcgggctgatagccgcggccgtcaatgacggcgcgcgcgcgcagcacttcgccgctggcgagctgcacgtgatcggggccgctgctggcgacggtctggttaagccgcagcgcgtcgccgagcgtcgcgcgcagcacctcgtcaaagcgcgcggaagtgacgcaaaaatagccgctgttaagctggcgcgtcagcgcgggaaagcgtacctcgtagtgcggccagcggtgcgccaccagcggcgcaatccactgatgctgcgcggcgctgagatcctcttcgtgaaagcaccaggtgtgattgccaccggcgtgggcgtgggcatcaagcaccagcacgcgcagctgcggctggagcgctttcagccgcagcgccagcagcccgttcgccagaccggcgccgagcaacagcagatcatactgcgatgtcatagtacttctccgcgcgctgtacatcatagcgtttctccggcgcgatgcagcggcgcaaggcgcagctggcgcagattagcgctgccggtgcagaaacaggcgacgcgcagctgttcaatcagcgtgttaaagtgcgcgaccaccgcatccgtagagtgcagggcgctgctgagcaccgccgccgcctggccaacgatatccgcgccgagccgcagcgccttcgccgcgtcgatgccgtcgcggatgccgcctgaggcgataagcggtatggcaggcagcctgtcgcgcaccgcgcgtaaggcttcatctgtgggaataccccagctggcaaaggccatcgccaccgcgcgctgctgcggggtgctggcgcgttcgccctctaccgccgcccagctggtgccgcccgcacctgcgatatcgatcatgctgacgcccgcctcggcgagccgctgcgcaacctcggccgagatgcccgcgccaacctctttcaccaccaccggcacctccagcgacttcaccagctgcgcaatcgcctgcagtacgccgcgccagtcgcgatcgccgccgcgctgcagcgcttcctgcagcggattaagatggacgatcagcgcatccgcctcgatcatgcttaccgcatttcgcgccagcctgcggccctgttcgcccagaatctgcgccgcgccgaggttcgccagcagcggaatatccggggcgatacggcgtaaatcgcgcgtcaggccagaatcgttgtcgctttccagcgccacgcgctgcgaaccgacccccagcgccagacccagcgtctgcgccgcttcggcaagatgatgattaatcgagagggcgcgcgccgcgccgccggtcattgagctaataagaaagggcgcctgcatggggcgatcgaacagccgcgtgcgcagatcgatctgatccaggtgcagctccggcagggcgcagtgggtaaagtgccagcgggcgaagctgcccgacgccggcgcggtattacgcagaacaatgtccagatgatcgtttttgcgcttcgtcaggtccgtgtccttcattgctgctccatatactcagacaggaaacgcgcggtcagccgaccatagcgagttttttatcgaaccaggcctgcacgaagtgccgggtggcgtagccgctgtcgcaggccgaagcgaggtggcgatcggcgcgtcgcagatggtcgcgcaggcgcttttctaccgctttgctgcccagcatgttcaccagcgtcgatttccccacgtcctgatgggcatcttttcccgtgtcgctctggccgtcggtcaggtcgtccagcagctgaaaggcctggccgagatcccgcgcgaagcggtgcagcttttcacgcgacgccagcggcgcgccggcgatgatggcggccatctgcatcgccgcgctgaacagcgcgctggttttaaagtggttggtcagctgaatggcgtcggcgctgcgcggctggccgccttcggtcagatcgagaaactgtccctgcaccagcccctgaatgccgactgaatgggaaagctccgccacggcctgggtcttcgcctggctgctgatgccgtccgccagcgcaatcacgccgaaggcgcggctcagcagggcgacggcggcgagaatcgccaccggctcgccgaactggcgatggattgtcggccggccgcgccgcagttcggcatcgtccatgcagggaatatcgtcgagtatcagcgaggcggcatgcaccatctcgacggcgcaggcgaagtcgagcagcccgctgagttcgtcgcgatagccaaggtcgtgagcggccagcatcagcagtaccggccggatgcgtttgcccggtgccagcgcgccttcgcgcatggcgagccccacgcagtctcgttcgctttctaccggcagcagtcggtcaagacgctgttcaataatcgccagtaacatcagaggatcgctgtagatgagagtagagtctctttcagcaaaaatggtcataatggcagtccttacttgcacctagttcaggcgccgttgctggatgagccgcgtttctgagacagttcggccttcagcgcgcgcgccgaccgcacccaaaggaagccgaacgatacgcagccctcgcgtgtccgcaccgcgtgatgcagccggtgggcctgaatgcgtcgcgtccagaacgccgagcgccctgcgatccctgtcgggaaccggcgatgcaccagcccgtcgtgaaagaagaaataaaccagtccataggccgtaacgcccaggccgatcggcagcatccaaggccacagatgtagacccaaggcgacgaggatgatggccggggcggcgaacaccaccgcgaacaggtcgttcctttccagcacgtcgtcgtgcggctcatgatggctgcggtgccaggtccacagcaggccgtgcatgacatagcgatgcatcgcccaggcgaagacctccatccccaggaaggtggcgaggaacagcaggatcatcgtcggccaggacatggtttattcctcctttctagtctagctgaacaaactccaccagggcttccagggggtcaggtggtgttcgtggtggcggccgaagtggaagcaggtgagcaacgacaggaccgggccgaaggggctggtgcgggcgttgtggttgtcggggaaggcgtcgtcggtgtgcctatgaggcagccaggtgccgaatgtgaaaagctgtagcgccgagagcagggcgggcgcggcccaaaagaccagaagattgggcatacgggcgccgaggatcagcaccgcaacggccacgagcaccgtcagaacggccagttctcgccagccgaaataggtgcggaaaaagccgtagaaccagggcaggaaagcgcgcggggcgtcggcgtgaaagtcgggatcgtccgccgtaccgggcgcagcgtgatgggcgtggtgtgcggtcttcaaaggcgtgaaccgaaatccggcgtagagggccagcgccaggctgccgatcgccgtgttcagccgtgggcgtgccggggccagcgagccgtgcatggcgtcgtgggcgacgatgaacaggccgacggatagccaggtctggccggcgacgatcagcggaacggtcaggacgctccagatcgtccagcgatgaaaatagacgccgtagatgtgcagggtcagccaggccgcggcgatcaggccagccagcgtcaggccgatcagggcctggttcgggacgacccgtgacattggcgtgacggcggacatggcgcgacacttagcgcatcgcggcccggtaagcatcctgttcgcttgccgcatggtttattcctccttgctagggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 16 - DNA, 780 bp, Brevundimonas vesicularis DC263
  CDS (1)..(780): beta-carotene ketolase (crtW)
atggggcaagcgaacaggatgcttaccgggccgcgatgcgctaagtgtcgcgccatgtccgccgtcacgccaatgtcacgggtcgtcccgaaccaggccctgatcggcctgacgctggctggcctgatcgccgcggcctggctgaccctgcacatctacggcgtctattttcatcgctggacgatctggagcgtcctgaccgttccgctgatcgtcgccggccagacctggctatccgtcggcctgttcatcgtcgcccacgacgccatgcacggctcgctggccccggcacgcccacggctgaacacggcgatcggcagcctggcgctggccctctacgccggatttcggttcacgcctttgaagaccgcacaccacgcccatcacgctgcgcccggtacggcggacgatcccgactttcacgccgacgccccgcgcgctttcctgccctggttctacggctttttccgcacctatttcggctggcgagaactggccgttctgacggtgctcgtggccgttgcggtgctgatcctcggcgcccgtatgcccaatcttctggtcttttgggccgcgcccgccctgctctcggcgctacagcttttcacattcggcacctggctgcctcataggcacaccgacgacgccttccccgacaaccacaacgcccgcaccagccccttcggcccggtcctgtcgttgctcacctgcttccacttcggccgccaccacgaacaccacctgaccccctggaagccctggtggagtttgttcagctag

SEQ ID NO: 17 - protein, 259 aa, Brevundimonas vesicularis DC263
MGQANRMLTGPRCAKCRAMSAVTPMSRVVPNQALIGLTLAGLIAAAWLTLHIYGVYFHRWTIWSVLTVPLIVAGQTWLSVGLFIVAHDAMHGSLAPARPRLNTAIGSLALALYAGFRFTPLKTAHHAHHAAPGTADDPDFHADAPRAFLPWFYGFFRTYFGWRELAVLTVLVAVAVLILGARMPNLLVFWAAPALLSALQLFTFGTWLPHRHTDDAFPDNHNARTSPFGPVLSLLTCFHFGRHHEHHLTPWKPWWSLFS

SEQ ID NO: 18 - DNA, 486 bp, Brevundimonas vesicularis DC263
  CDS (1)..(486): beta-carotene hydroxylase (crtZ)
atggcctggccgacgatgatcctgctgttcctcgccaccttcctggggatggaggtcttcgcctgggcgatgcatcgctatgtcatgcacggcctgctgtggacctggcaccgcagccatcatgagccgcacgacgacgtgctggaaaggaacgacctgttcgcggtggtgttcgccgccccggccatcatcctcgtcgccttgggtctacatctgtggccttggatgctgccgatcggcctgggcgttacggcctatggactggtttatttcttctttcacgacgggctggtgcatcgccggttcccgacagggatcgcagggcgctcggcgttctggacgcgacgcattcaggcccaccggctgcatcacgcggtgcggacacgcgagggctgcgtatcgttcggcttcctttgggtgcggtcggcgcgcgcgctgaaggccgaactgtctcagaaacgcggctcatccagcaacggcgcctga

SEQ ID NO: 19 - protein, 161 aa, Brevundimonas vesicularis DC263
MAWPTMILLFLATFLGMEVFAWAMHRYVMHGLLWTWHRSHHEPHDDVLERNDLFAVVFAAPAIILVALGLHLWPWMLPIGLGVTAYGLVYFFFHDGLVHRRFPTGIAGRSAFWTRRIQAHRLHHAVRTREGCVSFGFLWVRSARALKAELSQKRGSSSNGA

SEQ ID NO: 20 - DNA, 1161 bp, Pantoea stewartii DC413
  CDS (1)..(1161): lycopene cyclase (crtY)
atggcatcgcagtatgatctgctgttgctcggcgccggtctggcgaacgggctgctggcgctgcggctgaaagcgctccagccgcagctgcgcgtgctggtgcttgatgcccacgcccacgccggtggcaatcacacctggtgctttcacgaagaggatctcagcgccgcgcagcatcagtggattgcgccgctggtggcgcaccgctggccgcactacgaggtacgctttcccgcgctgacgcgccagcttaacagcggctatttttgcgtcacttccgcgcgctttgacgaggtgctgcgcgcgacgctcggcgacgcgctgcggcttaaccagaccgtcgccagcagcggccccgatcacgtgcagctcgccagcggcgaagtgctgcgcgcgcgcgccgtcattgacggccgcggctatcagcccgacgccgccctgcagattggctttcagtcttttgtcggtcaggagtggcgcctgagccagccgcatcagctggaggggccgattctgatggacgcggccgtggatcagcaggggggctatcgcttcgtctataccctgccgctctcgccgacgcgtctgctgattgaagatacccactatattaacgacgcctcgctggcgacggcgcaggcgcggcagaatatctgcgactacgccacccgccagggctggcagctggagacgctgctgcgcgaagagcgcggcgcgctgccgattacgctggcgggcgatttcgaccgcttctggcatcatcgcgccccctgcgtcggcctgcgcgccgggctttttcaccccacgaccggctactccctgccgctggcggcgacgctggcggacgcgctcgccgcagaggcggacttctcccctgaggcgctcgcgccgcgtattcaccgctttgcgcaggcagcgtggcgtaaacagggctttttccgcatgcttaaccgcatgctgttcctggcggccgagggcgatcggcgctggcgcgtaatgcagcgcttttacggcctgcccgaggggctgatcgcccggttttacgccggacggctgacgctggccgaccgcgcgcgcattcttagcggcaagccgccggtcccggtgctggcggcgctgcaggctattctcacccacccttctggacgaagagcatcacga

SEQ ID NO: 21 - protein, 387 aa, Pantoea stewartii DC413
MASQYDLLLLGAGLANGLLALRLKALQPQLRVLVLDAHAHAGGNHTWCFHEEDLSAAQHQWIAPLVAHRWPHYEVRFPALTRQLNSGYFCVTSARFDEVLRATLGDALRLNQTVASSGPDHVQLASGEVLRARAVIDGRGYQPDAALQIGFQSFVGQEWRLSQPHQLEGPILMDAAVDQQGGYRFVYTLPLSPTRLLIEDTHYINDASLATAQARQNICDYATRQGWQLETLLREERGALPITLAGDFDRFWHHRAPCVGLRAGLFHPTTGYSLPLAATLADALAAEADFSPEALAPRIHRFAQAAWRKQGFFRMLNRMLFLAAEGDRRWRVMQRFYGLPEGLIARFYAGRLTLADRARILSGKPPVPVLAALQAILTHPSGRRASR

SEQ ID NO: 22 - DNA, 25 bp, artificial sequence
  Primer crtY392_forward
ccatggcatcgcagtatgatctgct

SEQ ID NO: 23 - DNA, 33 bp, artificial sequence
  Primer crtY392_reverse
gcggccgctcatcgtgatgctcttcgtccagaa

SEQ ID NO: 24 - DNA, 24 bp, artificial sequence
  Primer crtZ392_forward
ccatggcctggccgacgatgatcc

SEQ ID NO: 25 - DNA, 34 bp, artificial sequence
  Primer crtZ392_reverse
gcggccgcagttcaggcgccgttgctggatgagc

SEQ ID NO: 26 - DNA, 23 bp, artificial sequence
  Primer crtW392_forward
ccatggggcaagcgaacaggatg

SEQ ID NO: 27 - DNA, 34 bp, artificial sequence
  Primer crtW392_reverse
gcggccgcagtctagctgaacaaactccaccagg

SEQ ID NO: 28 - DNA, 20 bp, artificial sequence
  Primer exp_forward
gttatgcagcgtacaccaca

SEQ ID NO: 29 - DNA, 27 bp, artificial sequence
  Primer HY-339_reverse
ctgtcgagcctgtgctgtagccaagga

SEQ ID NO: 30 - DNA, 14079 bp, artificial sequence
  Plasmid pYPS106
cgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcgacagcaactactcctttcaccaaccatgtgcattttagctcgaataacattcacaggcttggtgatctacatccatggtgtctggccgattaccgtggtgttttggcagtaacgagaatattgagtgaactcttcccatcaccaataaagactcatactacaatcacgagcgcttcagctgccactatagtgttggtgacacaatacccctcgatgctgggcattactgtagcaagagatattcatttcatggcgcattttccagtctacctgactttttagtgccgatttcttctccacattttacgctcagtgtgaaaagttggagtcgacttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgttatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggtcgctggcaagtccggagctgcagcccacgtgacccactcttccactctccctcgagagtaccacggtgctaccaacgactcccgatctgaggctgccgatgtcaccgtctcgtctatcgacgccgagaaggagatgattatcaacggacgagtgtacgacgtctcctcgttcgtgaagcgacaccctggtggctccgtcatcaagttccagctcggagcagatgcttctgacgcttacaacaacttccacgtccgatcgaagaaggctgacaagatgctgtactctcttccctcccgacctgccgaggctggctatgcacaggacgacatctctagagactttgagaagctgcgactggaactgaaagaggaaggttacttcgagcccaatctggtgcacgtgtcctaccgatgtgtcgaggtgcttgccatgtactgggctggcgtccagctgatctggtccggatactggttcctcggtgccatcgttgctggaattgctcaaggtcgatgcggatggctccagcatgaaggcggacactactcgctcactggcaacatcaagattgaccgacatctccagatggccatctatggactgggctgtggtatgtctggctgctactggagaaaccagcacaacaaacatcacgccactcctcagaagctcggaaccgatcccgacctgcagaccatgcctctcgttgccttccacaagattgtcggagccaaggcacgaggcaagggtaaagcctggcttgcttggcaagctcccctcttctttggaggcatcatttgctccctggtctctttcggctggcagttcgttctccaccccaatcatgcactgcgagtgcacaaccatctcgaactggcctacatgggtctccgatacgttctctggcaccttgcctttggccatctgggactcctgtcctctcttcgactgtatgccttctacgtggctgtcggtggcacctacatcttcaccaacttcgccgtctcccatactcacaaggatgtcgttcctcccaccaagcacatttcgtgggctctgtactctgccaaccacactaccaactgttccgactctccctttgtcaactggtggatggcctacctcaacttccagatcgagcaccatctgttcccctccatgcctcagtacaaccaccccaagattgctcctcgagtgcgagcactcttcgagaagcacggagtcgagtacgacgtccgaccctatctggaatgctttcgagtgacctacgtcaacctccttgctgttggcaaccctgagcactcctaccacgagcatactcactaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttgacaatggatggtgtgtcgtatcaggctggggaacaattgtgcttaagtatgctgcagttgagtaagagtcatcgctccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaacctcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgctcatcgtgatgctcttcgtccagaagggtgggtgagaatagcctgcagcgccgccagcaccgggaccggcggcttgccgctaagaatgcgcgcgcggtcggccagcgtcagccgtccggcgtaaaaccgggcgatcagcccctcgggcaggccgtaaaagcgctgcattacgcgccagcgccgatcgccctcggccgccaggaacagcatgcggttaagcatgcggaaaaagccctgtttacgccacgctgcctgcgcaaagcggtgaatacgcggcgcgagcgcctcaggggagaagtccgcctctgcggcgagcgcgtccgccagcgtcgccgccagcggcagggagtagccggtcgtggggtgaaaaagcccggcgcgcaggccgacgcagggggcgcgatgatgccagaagcggtcgaaatcgcccgccagcgtaatcggcagcgcgccgcgctcttcgcgcagcagcgtctccagctgccagccctggcgggtggcgtagtcgcagatattctgccgcgcctgcgccgtcgccagcgaggcgtcgttaatatagtgggtatcttcaatcagcagacgcgtcggcgagagcggcagggtatagacgaagcgatagcccccctgctgatccacggccgcgtccatcagaatcggcccctccagctgatgcggctggctcaggcgccactcctgaccgacaaaagactgaaagccaatctgcagggcggcgtcgggctgatagccgcggccgtcaatgacggcgcgcgcgcgcagcacttcgccgctggcgagctgcacgtgatcggggccgctgctggcgacggtctggttaagccgcagcgcgtcgccgagcgtcgcgcgcagcacctcgtcaaagcgcgcggaagtgacgcaaaaatagccgctgttaagctggcgcgtcagcgcgggaaagcgtacctcgtagtgcggccagcggtgcgccaccagcggcgcaatccactgatgctgcgcggcgctgagatcctcttcgtgaaagcaccaggtgtgattgccaccggcgtgggcgtgggcatcaagcaccagcacgcgcagctgcggctggagcgctttcagccgcagcgccagcagcccgttcgccagaccggcgccgagcaacagcagatcatactgcgatgccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccat

SEQ ID NO: 31 - DNA, 20 bp, artificial sequence
  Primer NT_forward
tatgtcggattggcgtagct

SEQ ID NO: 32 - DNA, 20 bp, artificial sequence
  Primer lip1-3_reverse
gtctgtggatgtggatggtg

SEQ ID NO: 33 - DNA, 13239 bp, artificial sequence
  Plasmid pYPS107
aaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttgacaatggatggtgtgtcgtatcaggctggggaacaattgtgcttaagtatgctgcagttgagtaagagtcatcgctccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaacctcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgctcatcgtgatgctcttcgtccagaagggtgggtgagaatagcctgcagcgccgccagcaccgggaccggcggcttgccgctaagaatgcgcgcgcggtcggccagcgtcagccgtccggcgtaaaaccgggcgatcagcccctcgggcaggccgtaaaagcgctgcattacgcgccagcgccgatcgccctcggccgccaggaacagcatgcggttaagcatgcggaaaaagccctgtttacgccacgctgcctgcgcaaagcggtgaatacgcggcgcgagcgcctcaggggagaagtccgcctctgcggcgagcgcgtccgccagcgtcgccgccagcggcagggagtagccggtcgtggggtgaaaaagcccggcgcgcaggccgacgcagggggcgcgatgatgccagaagcggtcgaaatcgcccgccagcgtaatcggcagcgcgccgcgctcttcgcgcagcagcgtctccagctgccagccctggcgggtggcgtagtcgcagatattctgccgcgcctgcgccgtcgccagcgaggcgtcgttaatatagtgggtatcttcaatcagcagacgcgtcggcgagagcggcagggtatagacgaagcgatagcccccctgctgatccacggccgcgtccatcagaatcggcccctccagctgatgcggctggctcaggcgccactcctgaccgacaaaagactgaaagccaatctgcagggcggcgtcgggctgatagccgcggccgtcaatgacggcgcgcgcgcgcagcacttcgccgctggcgagctgcacgtgatcggggccgctgctggcgacggtctggttaagccgcagcgcgtcgccgagcgtcgcgcgcagcacctcgtcaaagcgcgcggaagtgacgcaaaaatagccgctgttaagctggcgcgtcagcgcgggaaagcgtacctcgtagtgcggccagcggtgcgccaccagcggcgcaatccactgatgctgcgcggcgctgagatcctcttcgtgaaagcaccaggtgtgattgccaccggcgtgggcgtgggcatcaagcaccagcacgcgcagctgcggctggagcgctttcagccgcagcgccagcagcccgttcgccagaccggcgccgagcaacagcagatcatactgcgatgccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcgacagcaactactcctttcaccaaccatgtgcattttagctcgaataacattcacaggcttggtgatctacatccatggtgtctggccgattaccgtggtgttttggcagtaacgagaatattgagtgaactcttcccatcaccaataaagactcatactacaatcacgagcgcttcagctgccactatagtgttggtgacacaatacccctcgatgctgggcattactgtagcaagagatattcatttcatggcgcattttccagtctacctgactttttagtgccgatttcttctccacattttacgctcagtgtgaaaagttggagtcgacttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgttatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggcctggccgacgatgatcctgctgttcctcgccaccttcctggggatggaggtcttcgcctgggcgatgcatcgctatgtcatgcacggcctgctgtggacctggcaccgcagccatcatgagccgcacgacgacgtgctggaaaggaacgacctgttcgcggtggtgttcgccgccccggccatcatcctcgtcgccttgggtctacatctgtggccttggatgctgccgatcggcctgggcgttacggcctatggactggtttatttcttctttcacgacgggctggtgcatcgccggttcccgacagggatcgcagggcgctcggcgttctggacgcgacgcattcaggcccaccggctgcatcacgcggtgcggacacgcgagggctgcgtatcgttcggcttcctttgggtgcggtcggcgcgcgcgctgaaggccgaactgtctcagaaacgcggctcatccagcaacggcgcctgaactgcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaattt

SEQ ID NO: 34 - DNA, 20 bp, artificial sequence
  Primer GPAT_forward
actctgtcagccgatattgc

SEQ ID NO: 35 - DNA, 20 bp, artificial sequence
  Primer pex20_reverse
ctgcactcaagtgaaaccgt

SEQ ID NO: 36 - DNA, 12681 bp, artificial sequence
  Plasmid pYPS108
gtacgttatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggcctggccgacgatgatcctgctgttcctcgccaccttcctggggatggaggtcttcgcctgggcgatgcatcgctatgtcatgcacggcctgctgtggacctggcaccgcagccatcatgagccgcacgacgacgtgctggaaaggaacgacctgttcgcggtggtgttcgccgccccggccatcatcctcgtcgccttgggtctacatctgtggccttggatgctgccgatcggcctgggcgttacggcctatggactggtttatttcttctttcacgacgggctggtgcatcgccggttcccgacagggatcgcagggcgctcggcgttctggacgcgacgcattcaggcccaccggctgcatcacgcggtgcggacacgcgagggctgcgtatcgttcggcttcctttgggtgcggtcggcgcgcgcgctgaaggccgaactgtctcagaaacgcggctcatccagcaacggcgcctgaactgcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttgacaatggatggtgtgtcgtatcaggctggggaacaattgtgcttaagtatgctgcagttgagtaagagtcatcgctccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaacctcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgctcatcgtgatgctcttcgtccagaagggtgggtgagaatagcctgcagcgccgccagcaccgggaccggcggcttgccgctaagaatgcgcgcgcggtcggccagcgtcagccgtccggcgtaaaaccgggcgatcagcccctcgggcaggccgtaaaagcgctgcattacgcgccagcgccgatcgccctcggccgccaggaacagcatgcggttaagcatgcggaaaaagccctgtttacgccacgctgcctgcgcaaagcggtgaatacgcggcgcgagcgcctcaggggagaagtccgcctctgcggcgagcgcgtccgccagcgtcgccgccagcggcagggagtagccggtcgtggggtgaaaaagcccggcgcgcaggccgacgcagggggcgcgatgatgccagaagcggtcgaaatcgcccgccagcgtaatcggcagcgcgccgcgctcttcgcgcagcagcgtctccagctgccagccctggcgggtggcgtagtcgcagatattctgccgcgcctgcgccgtcgccagcgaggcgtcgttaatatagtgggtatcttcaatcagcagacgcgtcggcgagagcggcagggtatagacgaagcgatagcccccctgctgatccacggccgcgtccatcagaatcggcccctccagctgatgcggctggctcaggcgccactcctgaccgacaaaagactgaaagccaatctgcagggcggcgtcgggctgatagccgcggccgtcaatgacggcgcgcgcgcgcagcacttcgccgctggcgagctgcacgtgatcggggccgctgctggcgacggtctggttaagccgcagcgcgtcgccgagcgtcgcgcgcagcacctcgtcaaagcgcgcggaagtgacgcaaaaatagccgctgttaagctggcgcgtcagcgcgggaaagcgtacctcgtagtgcggccagcggtgcgccaccagcggcgcaatccactgatgctgcgcggcgctgagatcctcttcgtgaaagcaccaggtgtgattgccaccggcgtgggcgtgggcatcaagcaccagcacgcgcagctgcggctggagcgctttcagccgcagcgccagcagcccgttcgccagaccggcgccgagcaacagcagatcatactgcgatgccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcgacagcaactactcctttcaccaaccatgtgcattttagctcgaataacattcacaggcttggtgatctacatccatggtgtctggccgattaccgtggtgttttggcagtaacgagaatattgagtgaactcttcccatcaccaataaagactcatactacaatcacgagcgcttcagctgccactatagtgttggtgacacaatacccctcgatgctgggcattactgtagcaagagatattcatttcatggcgcattttccagtctacctgactttttagtgccgatttcttctccacattttacgctcagtgtgaaaagttggagtcgacttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggggcaagcgaacaggatgcttaccgggccgcgatgcgctaagtgtcgcgccatgtccgccgtcacgccaatgtcacgggtcgtcccgaaccaggccctgatcggcctgacgctggctggcctgatcgccgcggcctggctgaccctgcacatctacggcgtctattttcatcgctggacgatctggagcgtcctgaccgttccgctgatcgtcgccggccagacctggctatccgtcggcctgttcatcgtcgcccacgacgccatgcacggctcgctggccccggcacgcccacggctgaacacggcgatcggcagcctggcgctggccctctacgccggatttcggttcacgcctttgaagaccgcacaccacgcccatcacgctgcgcccggtacggcggacgatcccgactttcacgccgacgccccgcgcgctttcctgccctggttctacggctttttccgcacctatttcggctggcgagaactggccgttctgacggtgctcgtggccgttgcggtgctgatcctcggcgcccgtatgcccaatcttctggtcttttgggccgcgcccgccctgctctcggcgctacagcttttcacattcggcacctggctgcctcataggcacaccgacgacgccttccccgacaaccacaacgcccgcaccagccccttcggcccggtcctgtcgttgctcacctgcttccacttcggccgccaccacgaacaccacctgaccccctggaagccctggtggagtttgttcagctagactgcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 37 - DNA, 1161 bp, Pantoea stewartii DC413
  CDS (1)..(1161): synthetic lycopene cyclase (crtY) (codon-optimized for Yarrowia lipolytica)
atggcttcccagtacgacctgctccttctcggagctggtctggccaacggactcctggctctccgactgaaagccttgcagcctcaactgcgagtcttggttcttgatgctcacgcacacgctggtggcaaccatacctggtgcttccacgaggaagacctctctgctgcccagcatcagtggattgctcccttggtcgcacatcgttggcctcactacgaggttcgatttcccgctctgactagacagctcaactccggttacttctgtgtcacctcggcacgatttgacgaggttctgcgagccactctcggagatgctctgcgactcaaccagaccgtcgcatcctctggtccagaccacgttcagcttgccagcggcgaagtgctccgagctagagccgtcattgatggacgaggttaccaacccgacgctgcccttcagattggatttcagtccttcgttggtcaggagtggcgactgtctcagcctcatcagctcgaaggtcccattctgatggacgctgccgtggatcagcaaggaggctaccgtttcgtctatacacttcctctctcgcccacccgactgctcattgaggacactcactacatcaacgatgcctccttggctacagcacaggctcgacagaacatctgcgactacgccactcgacaaggatggcagctggagaccctgttgcgagaagagcgaggtgctctgcccatcactcttgcaggcgacttcgatcggttttggcatcaccgtgctccctgtgttggactgagagccggtctcttccatcctaccacaggttactcccttccactggctgccaccctcgctgacgccttggctgccgaggctgacttctctcccgaagcactcgctcctcgtattcaccgatttgcccaggctgcctggcgaaagcaaggctttttcagaatgttgaatcgaatgctgtttcttgctgccgagggagatcgaagatggcgagtcatgcagcgtttctacggtctgcccgagggcttgattgcccgattctatgctggacgactcacacttgccgacagagctcggattctcagcggaaagcctcccgttcctgtgctggctgccctccaggccatccttactcatccttctggtcgaagagcttcacga

SEQ ID NO: 38 - protein, 387 aa, Pantoea stewartii DC413; identical to SEQ ID NO: 21

SEQ ID NO: 39 - DNA, 780 bp, Brevundimonas vesicularis DC263
  CDS (1)..(780): synthetic beta-carotene ketolase (crtW) (codon-optimized for Yarrowia lipolytica)
atgggacaggctaaccgaatgctcaccggtcctcgatgtgccaagtgccgagccatgtccgctgtcactcccatgtctcgagttgtgcctaaccaggctctgatcggactcacccttgccggtctcattgcagctgcctggctgactcttcacatctacggagtctacttccacagatggaccatctggtccgtccttacagttcccttgatcgtcgctggtcagacctggctctctgttggcctcttcattgtcgctcacgatgccatgcacggatcccttgctccagcacgacctagactgaacactgccattggttctctcgcacttgccctgtacgctggctttcgattcactcctctcaagacagcccaccatgctcaccatgccgcacctggtactgctgatgatcccgactttcatgccgatgctcctcgagcctttctgccctggttctatggcttctttcgaacctacttcggatggcgagagcttgctgtcctcaccgttcttgtcgccgttgctgtcctcattctgggtgcccgaatgccaaacttgctggtcttctgggctgcacctgctctccttagcgccttgcaactgttcacctttggcacttggctccctcatcgacacaccgacgatgcctttcccgacaatcacaacgctcgaacttctccctttggacctgttctgtcccttctgacctgtttccacttcggtcgacatcacgagcatcacctcactccctggaagccttggtggtctctgttctcctaa

SEQ ID NO: 40 - protein, 259 aa, Brevundimonas vesicularis DC263; identical to SEQ ID NO: 17

SEQ ID NO: 41 - DNA, 486 bp, Brevundimonas vesicularis DC263
  CDS (1)..(486): synthetic beta-carotene hydroxylase (crtZ) (codon-optimized for Yarrowia lipolytica)
atggcttggcctaccatgatcctgctcttccttgctacctttctcggaatggaggtcttcgcctgggctatgcaccgatacgtcatgcacggtctgttgtggacttggcatcgttctcatcacgaaccccacgacgatgttctcgagcgaaacgacctgtttgccgtcgtgttcgctgcacctgccatcattctcgtcgctttgggtctccatctgtggccttggatgcttcccatcggactcggcgttactgcctacggactggtgtacttcttctttcacgacggtctcgtccatcgacggtttcccactggcattgctggtcgatctgccttctggacaagacgaatccaggctcacagactgcatcacgcagtgcgaacccgagagggatgcgtctcgttcggcttcctttgggttagatccgctcgagccctcaaggctgagctgtctcagaagcgaggttcctcttcgaacggagcctaa

SEQ ID NO: 42 - protein, 161 aa, Brevundimonas vesicularis DC263; identical to SEQ ID NO: 19

SEQ ID NO: 43 - DNA, 8252 bp, artificial sequence
  Plasmid pYPS127
ctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattgttcctctatagtagatctactatagaggaacatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttactgtatattcggtaagatatattttgtggggttttagtggtgtttggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttaattaactttggccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaggagaacagagaccaccaaggcttccagggagtgaggtgatgctcgtgatgtcgaccgaagtggaaacaggtcagaagggacagaacaggtccaaagggagaagttcgagcgttgtgattgtcgggaaaggcatcgtcggtgtgtcgatgagggagccaagtgccaaaggtgaacagttgcaaggcgctaaggagagcaggtgcagcccagaagaccagcaagtttggcattcgggcacccagaatgaggacagcaacggcgacaagaacggtgaggacagcaagctctcgccatccgaagtaggttcgaaagaagccatagaaccagggcagaaaggctcgaggagcatcggcatgaaagtcgggatcatcagcagtaccaggtgcggcatggtgagcatggtgggctgtcttgagaggagtgaatcgaaagccagcgtacagggcaagtgcgagagaaccaatggcagtgttcagtctaggtcgtgctggagcaagggatccgtgcatggcatcgtgagcgacaatgaagaggccaacagagagccaggtctgaccagcgacgatcaagggaactgtaaggacggaccagatggtccatctgtggaagtagactccgtagatgtgaagagtcagccaggcagctgcaatgagaccggcaagggtgagtccgatcagagcctggttaggcacaactcgagacatgggagtgacagcggacatggctcggcacttggcacatcgaggaccggtgagcattcggttagcctgtcccatggagag

SEQ ID NO: 44 - DNA, 7958 bp, artificial sequence
  Plasmid pYPS128
tactatagaggaacatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttactgtatattcggtaagatatattttgtggggttttagtggtgtttggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttaattaactttggccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaggctccgttcgaagaggaacctcgcttctgagacagctcagccttgagggctcgagcggatctaacccaaaggaagccgaacgagacgcatccctctcgggttcgcactgcgtgatgcagtctgtgagcctggattcgtcttgtccagaaggcagatcgaccagcaatgccagtgggaaaccgtcgatggacgagaccgtcgtgaaagaagaagtacaccagtccgtaggcagtaacgccgagtccgatgggaagcatccaaggccacagatggagacccaaagcgacgagaatgatggcaggtgcagcgaacacgacggcaaacaggtcgtttcgctcgagaacatcgtcgtggggttcgtgatgagaacgatgccaagtccacaacagaccgtgcatgacgtatcggtgcatagcccaggcgaagacctccattccgagaaaggtagcaaggaagagcaggatcatggtaggccaagccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattgttcctctatagtagatc

SEQ ID NO: 45 - DNA, 14688 bp, Artificial Sequence
  Plasmid pZKLeuN-29E3
cgattgttgtctactaactatcgtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgcccactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcgtacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgcttaagcaacgggcttgataacagcggggggggtgcccacgttgttgcggttgcggaagaacagaacacccttaccagcaccctcggcaccagcgctgggctcaacccactggcacatacgcgcactgcggtacatggcgcggatgaagccacgaggaccatcctggacatcagcccggtagtgcttgcccatgatgggcttaatggcctcggtggcctcgtccgcgttgtagaaggggatgctgctgacgtagtggtggaggacatgagtctcgatgatgccgtggagaaggtggcggccgatgaagcccatctcacggtcaatggtagcagcggcaccacggacgaagttccactcgtcgttggtgtagtggggaagggtagggtcggtgtgctggaggaaggtgatggcaacgagccagtggttaacccagaggtagggaacaaagtaccagatggccatgttgtagaaaccgaacttctgaacgaggaagtacagagcagtggccatcagaccgataccaatatcgctgaggacgatgagcttagcgtcactgttctcgtacagagggctgcggggatcgaagtggttaacaccaccgccgaggccgttatgcttgcccttgccgcgaccctcacgctggcgctcgtggtagttgtggccggtaacattggtgatgaggtagttgggccagccaacgagctgctgaaggacgagcatgagaagagtgaaagcgggggtctcctcagtaagatgagcgagctcgtgggtcatctttccgagacgagtagcctgctgctcgcgggttcggggaacgaagaccatgtcacgctccatgttgccagtggccttgtggtgctttcggtgggagatttgccagctgaagtaggggacaaggagggaagagtgaagaacccagccagtaatgtcgttgatgatgcgagaatcggagaaagcaccgtgaccgcactcatgggcaataacccagagaccagtaccgaaaagaccctgaagaacggtgtacacggcccacagaccagcgcgggcgggggtggaggggatatattcgggggtcacaaagttgtaccagatgctgaaagtggtagtcaggaggacaatgtcgcggaggatataaccgtatcccttgagagcggagcgcttgaagcagtgcttagggatggcattgtagatgtccttgatggtaaagtcgggaacctcgaactggttgccgtaggtgtcgagcatgacaccatactcggacttgggcttggcgatatcaacctcggacatggacgagagcgatgtggaagaggccgagtggcggggagagtctgaaggagagacggcggcagactcagaatccgtcacagtagttgaggtgacggtgcgtctaagcgcagggttctgcttgggcagagccgaagtggacgccatggttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtcgacatcatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgctcactgaatctttttggctcccttgtgcttcctgacgatatacgtttgcacatagaaattcaagaacaaacacaagactgtgccaacataaaagtaattgaagaaccagccaaacatcctcatcccatcttggcgataacagggaatgttcctgtacttccagacaatgtagaaaccaacattgaattgaatgatctgcattgatgtaatcagggattttggcatggggaacttcagcttgatcaatctggtccaataataaccgtacatgatccagtggatgaaaccattcaacagcacaaaaatccaaacagcttcatttcggtaattatagaacagccacatatccatcggtgcccccaaatgatggaagaattgcaaccaggtcagaggcttgcccatcagtggcaaatagaaggagtcaatatactccaggaacttgctcaaatagaacaactgcgtggtgatcctgaagacgttgttgtcaaaagccttctcgcagttgtcagacataacaccgatggtgtacatggcatatgccattgagaggaatgatcccaacgaataaatggacatgagaaggttgtaattggtgaaaacaaacttcatacgagactgaccttttggaccaagggggccaagagtgaacttcaagatgacaaatgcgatggacaagtaaagcacctcacagtgactggcatcactccagagttgggcataatcaactggttgggtaaaacttcctgcccaattgagactatttcattcaccacctccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgaacagcatgacattacaggtgggtgtgtaatcagggccctgattgctggtggtgggagcccccatcatgggcagatctgcgtacactgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatccccgctgatatgcctaaggaacaatcaaagaggaagatattaattcagaatgctagtatacagttagggat

SEQ ID NO: 46 - DNA, 1434 bp, Fusarium monoliforme
  CDS (1)..(1434): delta-12 desaturase
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: WO 2005/047485
  ref <311>: PATENT FILING DATE: 2004-11-12
  ref <312>: PUBLICATION DATE: 2005-05-26
  ref <313>: RELEVANT RESIDUES IN SEQ ID NO: (1)..(1434)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: US 2005-0216975-A1
  ref <311>: PATENT FILING DATE: 2004-11-10
  ref <312>: PUBLICATION DATE: 2005-09-29
  ref <313>: RELEVANT RESIDUES IN SEQ ID NO: (1)..(1434)
atggcgtccacttcggctctgcccaagcagaaccctgcgcttagacgcaccgtcacctcaactactgtgacggattctgagtctgccgccgtctctccttcagactctccccgccactcggcctcttccacatcgctctcgtccatgtccgaggttgatatcgccaagcccaagtccgagtatggtgtcatgctcgacacctacggcaaccagttcgaggttcccgactttaccatcaaggacatctacaatgccatccctaagcactgcttcaagcgctccgctctcaagggatacggttatatcctccgcgacattgtcctcctgactaccactttcagcatctggtacaactttgtgacccccgaatatatcccctccacccccgcccgcgctggtctgtgggccgtgtacaccgttcttcagggtcttttcggtactggtctctgggttattgcccatgagtgcggtcacggtgctttctccgattctcgcatcatcaacgacattactggctgggttcttcactcttccctccttgtcccctacttcagctggcaaatctcccaccgaaagcaccacaaggccactggcaacatggagcgtgacatggtcttcgttccccgaacccgcgagcagcaggctactcgtctcggaaagatgacccacgagctcgctcatcttactgaggagacccccgctttcactcttctcatgctcgtccttcagcagctcgttggctggcccaactacctcatcaccaatgttaccggccacaactaccacgagcgccagcgtgagggtcgcggcaagggcaagcataacggcctcggcggtggtgttaaccacttcgatccccgcagccctctgtacgagaacagtgacgctaagctcatcgtcctcagcgatattggtatcggtctgatggccactgctctgtacttcctcgttcagaagttcggtttctacaacatggccatctggtactttgttccctacctctgggttaaccactggctcgttgccatcaccttcctccagcacaccgaccctacccttccccactacaccaacgacgagtggaacttcgtccgtggtgccgctgctaccattgaccgtgagatgggcttcatcggccgccaccttctccacggcatcatcgagactcatgtcctccaccactacgtcagcagcatccccttctacaacgcggacgaggccaccgaggccattaagcccatcatgggcaagcactaccgggctgatgtccaggatggtcctcgtggcttcatccgcgccatgtaccgcagtgcgcgtatgtgccagtgggttgagcccagcgctggtgccgagggtgctggtaagggtgttctgttcttccgcaaccgcaacaacgtgggcaccccccccgctgttatcaagcccgttgcttaa

SEQ ID NO: 47 - protein, 477 aa, Fusarium monoliforme
MASTSALPKQNPALRRTVTSTTVTDSESAAVSPSDSPRHSASSTSLSSMSEVDIAKPKSEYGVMLDTYGNQFEVPDFTIKDIYNAIPKHCFKRSALKGYGYILRDIVLLTTTFSIWYNFVTPEYIPSTPARAGLWAVYTVLQGLFGTGLWVIAHECGHGAFSDSRIINDITGWVLHSSLLVPYFSWQISHRKHHKATGNMERDMVFVPRTREQQATRLGKMTHELAHLTEETPAFTLLMLVLQQLVGWPNYLITNVTGHNYHERQREGRGKGKHNGLGGGVNHFDPRSPLYENSDAKLIVLSDIGIGLMATALYFLVQKFGFYNMAIWYFVPYLWVNHWLVAITFLQHTDPTLPHYTNDEWNFVRGAAATIDREMGFIGRHLLHGIIETHVLHHYVSSIPFYNADEATEAIKPIMGKHYRADVQDGPRGFIRAMYRSARMCQWVEPSAGAEGAGKGVLFFRNRNNVGTPPAVIKPVA

SEQ ID NO: 48 - DNA, 777 bp, Euglena gracilis
  CDS (1)..(777): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(777)
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtga

SEQ ID NO: 49 - protein, 258 aa, Euglena gracilis
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 50 - DNA, 777 bp, Euglena gracilis
  CDS (1)..(777): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US-2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(777)
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 51 - protein, 258 aa, Euglena gracilis; identical to SEQ ID NO: 49

SEQ ID NO: 52 - DNA, 828 bp, Mortierella alpina
  CDS (1)..(828): synthetic C16/18 elongase (codon-optimized for Yarrowia lipolytica)
  ref <302>: TITLE: A MORTIERELLA ALPINA C16/18 FATTY ACID ELONGASE
  ref <310>: PATENT DOCUMENT NUMBER: US 2007-0087420-A1
  ref <311>: PATENT FILING DATE: 2005-10-19
  ref <312>: PUBLICATION DATE: 2007-04-19
  ref <313>: RELEVANT RESIDUES IN SEQ ID NO: (1)..(828)
  ref <302>: TITLE: A MORTIERELLA ALPINA C16/18 FATTY ACID ELONGASE
  ref <310>: PATENT DOCUMENT NUMBER: WO 2007/046817
  ref <311>: PATENT FILING DATE: 2005-11-04
  ref <312>: PUBLICATION DATE: 2007-04-26
  ref <313>: RELEVANT RESIDUES IN SEQ ID NO: (1)..(828)
atggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaa

SEQ ID NO: 53 - protein, 275 aa, Mortierella alpina
MESGPMPAGIPFPEYYDFFMDWKTPLAIAATYTAAVGLFNPKVGKVSRVVAKSANAKPAERTQSGAAMTAFVFVHNLILCVYSGITFYYMFPAMVKNFRTHTLHEAYCDTDQSLWNNALGYWGYLFYLSKFYEVIDTIIIILKGRRSSLLQTYHHAGAMITMWSGINYQATPIWIFVVFNSFIHTIMYCYYAFTSIGFHPPGKKYLTSMQITQFLVGITIAVSYLFVPGCIRTPGAQMAVWINVGYLFPLTYLFVDFAKRTYSKRSAIAAQKKAQ

SEQ ID NO: 54 - DNA, 8739 bp, Artificial Sequence
  Plasmid pY116
ggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggtttaaacgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaattaattaatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaagc

SEQ ID NO: 55 - DNA, 15337 bp, Artificial Sequence
  Plasmid pKO2UF8289
cgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgcttcctgacgatatacgtttgcacatagaaattcaagaacaaacacaagactgtgccaacataaaagtaattgaagaaccagccaaacatcctcatcccatcttggcgataacagggaatgttcctgtacttccagacaatgtagaaaccaacattgaattgaatgatctgcattgatgtaatcagggattttggcatggggaacttcagcttgatcaatctggtccaataataaccgtacatgatccagtggatgaaaccattcaacagcacaaaaatccaaacagcttcatttcggtaattatagaacagccacatatccatcggtgcccccaaatgatggaagaattgcaaccaggtcagaggcttgcccatcagtggcaaatagaaggagtcaatatactccaggaacttgctcaaatagaacaactgcgtggtgatcctgaagacgttgttgtcaaaagccttctcgcagttgtcagacataacaccgatggtgtacatggcatatgccattgagaggaatgatcccaacgaataaatggacatgagaaggttgtaattggtgaaaacaaacttcatacgagactgaccttttggaccaagggggccaagagtgaacttcaagatgacaaatgcgatggacaagtaaagcacctcacagtgactggcatcactccagagttgggcataatcaactggttgggtaaaacttcctgcccaattgagactatttcattcaccacctccatggttagcgtgtcgtgtttttgttgtgctggaagaaccaaagggtggcgcaatgtgtgtagatatatatgtcgtgacccacaagtcacacaaacaagtatcgggaggagtggtgcacctctatgcggagaaaccttataccgctgtagaccaactggggcagaggtgtgagttgaagtcagctggaggagatgtgtgacagaagcacaagaagtgagattgtgagatgtatgtctagggggggaagttttgtgtcaaatatatgggaattattatcagcaccacgaaattatacgcctcatatgacccatttaggtggatagatcatggacactgttgacagctgcgaagaaaaagcgtattggggatgatccgaaattagtccggtaccgaggcgcaaatacgtaagacagccgatwaaatatatgcgagaaacaccaaagagactctagatgtttgtttggcacagttttgacttctgcgaaggccttacaccaccttgttgacccttgtcgcgggtcgggcaatatcggctgacagagttttacttgctcaataagatacgagctgcatagagttgaactacaggacaatattggggctggccacatgaagggcattgtttggaggtgtattgatggtgaaaacacgatatgaaatgacaacgccccctgttttattattattcttattattttgggtgcttctctatccatacaagcacctcctaacatgcttcataagtgacctcctcatcacaaggcctgaggtctcatttatccagtggcgccaagctaaactaaaactggtccgagtagactaaggcgaagagagaaggagagaagacagtttttttgtggccgcctgtgaacaatgaaaacgatgagggtgagatggagcaaaccatatggtttaaacagtcagaggagtacacgctgcttacataatggcgcaacgaccacatgtcccacagatacgcatcgattcgattcaaattaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcaccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgtttaaacagtgtacgcagatcccgtcaacagttttatatatcgtagttacaaccatcaacactttttggtaagtgtaccattctatactccaactggtctgcaactgtacaagtagacatgttaatggtagttaataacatctacagcagaacctatggtaaagacattgcatttttacaggaagtatcgtcctacacgttgataaatccaaagatgcggaacttcttccacttttatcatcatcccctactcgtacactcgtactctttgttcgatcgcgattcatttctataaataatcttgtatgtacatgcggccgcttaagcaacgggcttgataacagcggggggggtgcccacgttgttgcggttgcggaagaacagaacacccttaccagcaccctcggcaccagcgctgggctcaacccactggcacatacgcgcactgcggtacatggcgcggatgaagccacgaggaccatcctggacatcagcccggtagtgcttgcccatgatgggcttaatggcctcggtggcctcgtccgcgttgtagaaggggatgctgctgacgtagtggtggaggacatgagtctcgatgatgccgtggagaaggtggcggccgatgaagcccatctcacggtcaatggtagcagcggcaccacggacgaagttccactcgtcgttggtgtagtggggaagggtagggtcggtgtgctggaggaaggtgatggcaacgagccagtggttaacccagaggtagggaacaaagtaccagatggccatgttgtagaaaccgaacttctgaacgaggaagtacagagcagtggccatcagaccgataccaatatcgctgaggacgatgagcttagcgtcactgttctcgtacagagggctgcggggatcgaagtggttaacaccaccgccgaggccgttatgcttgcccttgccgcgaccctcacgctggcgctcgtggtagttgtggccggtaacattggtgatgaggtagttgggccagccaacgagctgctgaaggacgagcatgagaagagtgaaagcgggggtctcctcagtaagatgagcgagctcgtgggtcatctttccgagacgagtagcctgctgctcgcgggttcggggaacgaagaccatgtcacgctccatgttgccagtggccttgtggtgctttcggtgggagatttgccagctgaagtaggggacaaggagggaagagtgaagaacccagccagtaatgtcgttgatgatgcgagaatcggagaaagcaccgtgaccgcactcatgggcaataacccagagaccagtaccgaaaagaccctgaagaacggtgtacacggcccacagaccagcgcgggcgggggtggaggggatatattcgggggtcacaaagttgtaccagatgctgaaagtggtagtcaggaggacaatgtcgcggaggatataaccgtatcccttgagagcggagcgcttgaagcagtgcttagggatggcattgtagatgtccttgatggtaaagtcgggaacctcgaactggttgccgtaggtgtcgagcatgacaccatactcggacttgggcttggcgatatcaacctcggacatggacgagagcgatgtggaagaggccgagtggcggggagagtctgaaggagagacggcggcagactcagaatccgtcacagtagttgaggtgacggtgcgtctaagcgcagggttctgcttgggcagagccgaagtggacgccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctacatttctcccttgctccaactatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggtgaagcttccactggtcggcgtggtagtggggcagagtggggtcggtgtgctgcaggtaggtgatggccacgagccagtggttgacccacaggtaggggatcaggtagtagagggtgacggaagccaggccccatcggttgatggagtatgcgatgacggacatggtgataccaataccgacgttagagatccagatgttgaaccagtccttcttctcaaacagcggggcgttggggttgaagtggttgacagcccatttgttgagcttggggtacttctgtccggtaacgtaagacagcagatacagaggccatccaaacacctgctgggtgatgaggccgtagagggtcatgaggggagcgtcctcagcaagctcagaccagtcatgggcgcctcggttctccataaactcctttcggtccttgggcacaaacaccatatcacgggtgaggtgaccagtggacttgtggtgcatggagtgggtcagcttccaggcgtagtaagggaccagcatggaggagtgcagaacccatccggtgacgttgttgacggtgttagagtcggagaaagcagagtggccacactcgtgggcaagaacccacagaccggtgccaaacagaccctggacaatggagtacatggcccaggccacagctcggccggaagccgagggaataagaggcaggtacgcgtaggccatgtaggcaaaaacggcgataaagaagcaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttgaatctacaagtaggagggttggagtgattaagtgaaacttctttaacggctctatgccagttctattgatatccgaaacatcagtatgaaggtctgataagggtgacttcttcccacagattcgtatcagtacgagtacgagaccggtacttgtaacagtattgatactaaagggaaactacaacggttgtcagcgtaatgtgacttcgcccatgaacgcagacacgcagtgccgagtgcggtgatatcgcctactcgttacgtccatggactacacaacccctcggcttcgcttggcttagcctcgggctcggtgctgttcagttaaaacacaatcaaataacatttctactttttagaaggcaggccgtcaggagcaactccgactccattgacgtttctaaacatctgaatgccttccttaccttcaacaaactggcaggttcgggcgacagtgtaaagagacttgatgaagttggtgtcgtcgtgtcggtagtgcttgcccatgaccttcttgatcttctcagtggcgattcgggcgttgtagaagggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaat

SEQ ID NO: 56 - DNA, 1936 bp, Yarrowia lipolytica
  CDS (283)..(1539)
  ref <302>: TITLE: A  DELTA-12 DESATURASE GENE SUITABLE FOR ALTERING LEVELS OF POLYUNSATURATED FATTY ACIDS IN OLEAGINOUS YEASTS
  ref <310>: PATENT DOCUMENT NUMBER: U.S. 7,214,491
  ref <311>: PATENT FILING DATE: 2004-05-06
  ref <312>: PUBLICATION DATE: 2007-05-08
  ref <313>: RELEVANT RESIDUES IN SEQ ID NO: (1)..(1936)
  ref <302>: TITLE: A  DELTA-12 DESATURASE GENE SUITABLE FOR ALTERING LEVELS OF POLYUNSATURATED FATTY ACIDS IN OLEAGINOUS YEASTS
  ref <310>: PATENT DOCUMENT NUMBER: WO 2004/104167
  ref <311>: PATENT FILING DATE: 2004-05-07
  ref <312>: PUBLICATION DATE: 2004-12-02
  ref <313>: RELEVANT RESIDUES IN SEQ ID NO: (1)..(1936)
cgtagttatatacaagaggtagatgcgtgctggtgttagaggggctctcaggattaggaggaaaatttgacattggccctcaacatataacctcgggtgtgcctctgtttaccctcagcttttgcttgtccccaagtcagtcacgccaggccaaaaaggttggtggattgacagggagaaaaaaaaaagcctagtgggtttaaactcgaggtaagacattgaaatatataccggtcggcatcctgagtccctttctcgtattccaacagaccgaccatagaaatggattcgaccacgcagaccaacaccggcaccggcaaggtggccgtgcagccccccacggccttcattaagcccattgagaaggtgtccgagcccgtctacgacacctttggcaacgagttcactcctccagactactctatcaaggatattctggatgccattccccaggagtgctacaagcggtcctacgttaagtcctactcgtacgtggcccgagactgcttctttatcgccgtttttgcctacatggcctacgcgtacctgcctcttattccctcggcttccggccgagctgtggcctgggccatgtactccattgtccagggtctgtttggcaccggtctgtgggttcttgcccacgagtgtggccactctgctttctccgactctaacaccgtcaacaacgtcaccggatgggttctgcactcctccatgctggtcccttactacgcctggaagctgacccactccatgcaccacaagtccactggtcacctcacccgtgatatggtgtttgtgcccaaggaccgaaaggagtttatggagaaccgaggcgcccatgactggtctgagcttgctgaggacgctcccctcatgaccctctacggcctcatcacccagcaggtgtttggatggcctctgtatctgctgtcttacgttaccggacagaagtaccccaagctcaacaaatgggctgtcaaccacttcaaccccaacgccccgctgtttgagaagaaggactggttcaacatctggatctctaacgtcggtattggtatcaccatgtccgtcatcgcatactccatcaaccgatggggcctggcttccgtcaccctctactacctgatcccctacctgtgggtcaaccactggctcgtggccatcacctacctgcagcacaccgaccccactctgccccactaccacgccgaccagtggaacttcacccgaggagccgccgccaccatcgaccgagagtttggcttcatcggctccttctgcttccatgacatcatcgagacccacgttctgcaccactacgtgtctcgaattcccttctacaacgcccgaatcgccactgagaagatcaagaaggtcatgggcaagcactaccgacacgacgacaccaacttcatcaagtctctttacactgtcgcccgaacctgccagtttgttgaaggtaaggaaggcattcagatgtttagaaacgtcaatggagtcggagttgctcctgacggcctgccttctaaaaagtagagctagaaatgttatttgattgtgttttaactgaacagcaccgagcccgaggctaagccaagcgaagccgaggggttgtgtagtccatggacgtaacgagtaggcgatatcaccgcactcggcactgcgtgtctgcgttcatgggcgaagtcacattacgctgacaaccgttgtagtttccctttagtatcaatactgttacaagtaccggtctcgtactcgtactgatacgaatctgtgggaagaagtcacccttatcagaccttcatactgatgtttcggatatcaatagaactggcatagagccgttaaagaagtttcacttaatcactccaaccctcctacttgtagattcaagcagatcgataagatggatttgatggtcagtgctagc

SEQ ID NO: 57 - protein, 419 aa, Yarrowia lipolytica
MDSTTQTNTGTGKVAVQPPTAFIKPIEKVSEPVYDTFGNEFTPPDYSIKDILDAIPQECYKRSYVKSYSYVARDCFFIAVFAYMAYAYLPLIPSASGRAVAWAMYSIVQGLFGTGLWVLAHECGHSAFSDSNTVNNVTGWVLHSSMLVPYYAWKLTHSMHHKSTGHLTRDMVFVPKDRKEFMENRGAHDWSELAEDAPLMTLYGLITQQVFGWPLYLLSYVTGQKYPKLNKWAVNHFNPNAPLFEKKDWFNIWISNVGIGITMSVIAYSINRWGLASVTLYYLIPYLWVNHWLVAITYLQHTDPTLPHYHADQWNFTRGAAATIDREFGFIGSFCFHDIIETHVLHHYVSRIPFYNARIATEKIKKVMGKHYRHDDTNFIKSLYTVARTCQFVEGKEGIQMFRNVNGVGVAPDGLPSKK

SEQ ID NO: 58 - DNA, 1272 bp, Artificial Sequence
  mutant EgD8S-23 delta-8 desaturase
  CDS (2)..(1270)
catggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagc

SEQ ID NO: 59 - protein, 422 aa, Artificial Sequence
  Synthetic Construct
MVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 60 - DNA, 1272 bp, Euglena gracilis
  CDS (2)..(1270): synthetic delta-8 desaturase (codon-optimized for Yarrowia lipolytica) ("D8SF" or "EgD8S")
  ref <302>: TITLE: DELTA-8 DESATURASE AND ITS USE IN MAKING POLYUNSATURATED FATTY ACIDS
  ref <310>: PATENT DOCUMENT NUMBER: WO 2006/012325 and WO 2006/012326
  ref <311>: PATENT FILING DATE: 2005-06-24
  ref <312>: PUBLICATION DATE: 2006-02-02
  ref <313>: RELEVANT RESIDUES IN SEQ ID NO: (1)..(1272)
  ref <302>: TITLE: DELTA-8 DESATURASE AND ITS USE IN MAKING POLYUNSATURATED FATTY ACIDS
  ref <310>: PATENT DOCUMENT NUMBER: US-2005-0287652-A1
  ref <311>: PATENT FILING DATE: 2005-06-24
  ref <312>: PUBLICATION DATE: 2005-12-29
  ref <313>: RELEVANT RESIDUES IN SEQ ID NO: (1)..(1272)
catggtgaagtccaagcgacaggctctgcccctcaccatcgacggaactacctacgacgtctccgcttgggtgaacttccaccctggtggagctgaaatcattgagaactaccagggacgagatgctactgacgccttcatggttatgcactctcaggaagccttcgacaagctcaagcgaatgcccaagatcaacccctcctccgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgctcctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagc

SEQ ID NO: 61 - protein, 422 aa, Euglena gracilis
MVKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 62 - DNA, 13707 bp, Artificial Sequence
  Plasmid pZKSL-555R
aaacagtgtacgcagatctgcccatgatgggggctcccaccaccagcaatcagggccctgattacacacccacctgtaatgtcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggctctctcccttactaccgagcagctgctcgagcgacccgacctggttgccatcgacggcattctctacgatctggaaggtcttgccaaggtccatcccggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgctgtgttgttgtatgtggtgaagcttgacaatggatggtgtgtcgtatcaggctggggaacaattgtgcttaagtatgctgcagttgagtaagagtcatcgctccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaacctcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggaatcctgtgcgtccttcacgcagtggacgacacccaccttatgcatgtacttcagggtggagatgatgttgccgacgatggtagggtagaaaacatatcgcactccatgtcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagatcgcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcctggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgggacgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaactgttgaagcaatttggagttctccggtttgacgtatggatgcattgaataaaagagaggggaggcatcagaggcaccagaagcgagaatcaaatctcctcctggatgaactttggcaagcccttcaaggtcgtagaggatgccatcaatcgcaaccaaatcagggcgttctaacagctgttctgtggtaagactgagagccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattggggctgttttttgggacacaaatacgccgccaacccggtctctcctgaattccgtcgtcgcctgagtcgacatcatttatttaccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaactcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctcccgacgccgacaagctgcgacagcgaaaggctcagtccatccaggacactgccgattctcaggctaccgagctcaagattggcaccctgaagggtctccaaggcaccgagatcgtcattgatggcgacatctacgacatcaaagacttcgatcaccctggaggcgaatccatcatgacctttggtggcaacgacgttactgccacctacaagatgattcatccctaccactcgaagcatcacctggagaagatgaaaaaggtcggtcgagtgcccgactacacctccgagtacaagttcgatactcccttcgaacgagagatcaaacaggaggtcttcaagattgtgcgaagaggtcgagagtttggaacacctggctacttctttcgagccttctgctacatcggtctcttcttttacctgcagtatctctgggttaccactcctaccactttcgcccttgctatcttctacggtgtgtctcaggccttcattggcctgaacgtccagcacgacgccaaccacggagctgcctccaaaaagccctggatcaacaatttgctcggcctgggtgccgactttatcggaggctccaagtggctctggatgaaccagcactggacccatcacacttacaccaaccatcacgagaaggatcccgacgccctgggtgcagagcctatgctgctcttcaacgactatcccttgggtcaccccaagcgaaccctcattcatcacttccaagccttctactatctgtttgtccttgctggctactgggtgtcttcggtgttcaaccctcagatcctggacctccagcaccgaggtgcccaggctgtcggcatgaagatggagaacgactacattgccaagtctcgaaagtacgctatcttcctgcgactcctgtacatctacaccaacattgtggctcccatccagaaccaaggcttttcgctcaccgtcgttgctcacattcttactatgggtgtcgcctccagcctgaccctcgctactctgttcgccctctcccacaacttcgagaacgcagatcgggatcccacctacgaggctcgaaagggaggcgagcctgtctgttggttcaagtcgcaggtggaaacctcctctacttacggtggcttcatttccggttgccttacaggcggactcaactttcaggtcgagcatcacctgtttcctcgaatgtcctctgcctggtacccctacatcgctcctaccgttcgagaggtctgcaaaaagcacggcgtcaagtacgcctactatccctgggtgtggcagaacctcatctcgaccgtcaagtacctgcatcagtccggaactggctcgaactggaagaacggtgccaatccctactctggcaagctgtaagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatctgcgtacactgttt

SEQ ID NO: 63 - DNA, 1350 bp, Euglena gracilis
  CDS (1)..(1350): synthetic delta-5 desaturase (codon-optimized for Yarrowia lipolytica)
atggctctctcccttactaccgagcagctgctcgagcgacccgacctggttgccatcgacggcattctctacgatctggaaggtcttgccaaggtccatcccggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 64 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 65 - DNA, 1392 bp, Peridinium sp. CCMP626
  CDS (1)..(1392): synthetic delta-5 desaturase (codon-optimized for Yarrowia lipolytica)
atggctcccgacgccgacaagctgcgacagcgaaaggctcagtccatccaggacactgccgattctcaggctaccgagctcaagattggcaccctgaagggtctccaaggcaccgagatcgtcattgatggcgacatctacgacatcaaagacttcgatcaccctggaggcgaatccatcatgacctttggtggcaacgacgttactgccacctacaagatgattcatccctaccactcgaagcatcacctggagaagatgaaaaaggtcggtcgagtgcccgactacacctccgagtacaagttcgatactcccttcgaacgagagatcaaacaggaggtcttcaagattgtgcgaagaggtcgagagtttggaacacctggctacttctttcgagccttctgctacatcggtctcttcttttacctgcagtatctctgggttaccactcctaccactttcgcccttgctatcttctacggtgtgtctcaggccttcattggcctgaacgtccagcacgacgccaaccacggagctgcctccaaaaagccctggatcaacaatttgctcggcctgggtgccgactttatcggaggctccaagtggctctggatgaaccagcactggacccatcacacttacaccaaccatcacgagaaggatcccgacgccctgggtgcagagcctatgctgctcttcaacgactatcccttgggtcaccccaagcgaaccctcattcatcacttccaagccttctactatctgtttgtccttgctggctactgggtgtcttcggtgttcaaccctcagatcctggacctccagcaccgaggtgcccaggctgtcggcatgaagatggagaacgactacattgccaagtctcgaaagtacgctatcttcctgcgactcctgtacatctacaccaacattgtggctcccatccagaaccaaggcttttcgctcaccgtcgttgctcacattcttactatgggtgtcgcctccagcctgaccctcgctactctgttcgccctctcccacaacttcgagaacgcagatcgggatcccacctacgaggctcgaaagggaggcgagcctgtctgttggttcaagtcgcaggtggaaacctcctctacttacggtggcttcatttccggttgccttacaggcggactcaactttcaggtcgagcatcacctgtttcctcgaatgtcctctgcctggtacccctacatcgctcctaccgttcgagaggtctgcaaaaagcacggcgtcaagtacgcctactatccctgggtgtggcagaacctcatctcgaccgtcaagtacctgcatcagtccggaactggctcgaactggaagaacggtgccaatccctactctggcaagctgtaa

SEQ ID NO: 66 - protein, 463 aa, Peridinium sp. CCMP626
MAPDADKLRQRKAQSIQDTADSQATELKIGTLKGLQGTEIVIDGDIYDIKDFDHPGGESIMTFGGNDVTATYKMIHPYHSKHHLEKMKKVGRVPDYTSEYKFDTPFEREIKQEVFKIVRRGREFGTPGYFFRAFCYIGLFFYLQYLWVTTPTTFALAIFYGVSQAFIGLNVQHDANHGAASKKPWINNLLGLGADFIGGSKWLWMNQHWTHHTYTNHHEKDPDALGAEPMLLFNDYPLGHPKRTLIHHFQAFYYLFVLAGYWVSSVFNPQILDLQHRGAQAVGMKMENDYIAKSRKYAIFLRLLYIYTNIVAPIQNQGFSLTVVAHILTMGVASSLTLATLFALSHNFENADRDPTYEARKGGEPVCWFKSQVETSSTYGGFISGCLTGGLNFQVEHHLFPRMSSAWYPYIAPTVREVCKKHGVKYAYYPWVWQNLISTVKYLHQSGTGSNWKNGANPYSGKL

SEQ ID NO: 67 - DNA, 1350 bp, Euglena gracilis
  CDS (1)..(1350): delta-5 desaturase
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctga

SEQ ID NO: 68 - protein, 449 aa, Euglena gracilis; identical to SEQ ID NO: 64

SEQ ID NO: 69 - DNA, 13066 bp, Artificial Sequence
  Plasmid pZP3-Pa777U
tctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccaccaatcacaattctgaaaagcacatcttgatctcctcattgcggggagtccaacggtggtcttattcccccgaatttcccgctcaatctcgttccagaccgacccggacacagtgcttaacgccgttccgaaactctaccgcagatatgctccaacggactgggctgcatagatgtgatcctcggcttggagaaatggataaaagccggccaaaaaaaaagcggaaaaaagcggaaaaaaagagaaaaaaaatcgcaaaatttgaaaaatagggggaaaagacgcaaaaacgcaaggaggggggagtatatgacactgataagcaagctcacaacggttcctcttatttttttcctcatcttctgcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgcttagttggctttggtcttggcagccttggcctccttgagggtaaacatcttggcatccttgtcgaccacgccgtacttggcgtacataagaccaattcggatgaaggtgggaatgatgggagaagccgactttcgcaccagttcgggaaaggcctgagcgaaggcagcagtggcctcgttgagcttgtagtgaggaatgatgggaaacagatggtggatctgatgtgtaccaatgttgtgggacaggttgtcgatgagggctccgtagcttcggtccacagaggacaagttgcccttgacataggtccactccgaatcggcgtaccagggagtttcctcgtcgttgtgatggaggaaggtagtgacaaccagcatggtggcgaatccaaagagaggtgcgaagtaatacagagccatggtcttgaggccgtagacgtaggtaaggtaggcgtacagaccagcaaaggccacgagagagccgagggaaatgatgacggcagacattcttcgcaggtagagaggctcccagggattgaagtggttgacctttcggggaggaaatccagcaacgaggtaggcaaaccaagccgaaccaagggagatgaccatgtgtcgggacaggggatgagagtcggcttctcgctgagggtagaagatctcatccttgtcgatgttgccggtgttcttgtgatggtgtcgatggctgatcttccacgactcgtagggagtcagaatgatggagtgaatgagtgtgccaacagagaagttgagcaggtgggatcgcgagaaggcaccatgtccacagtcgtgaccgatggtaaagaatccccagaacacgataccctggagcagaatgtagccagtgcaaaggacggcatcgagcagtgcaaactcctgcacgatagcaagggctcgagcatagtacagtccgagagcaagggaaccggcaatgcccagagctcgcacggtatagtagagggaccagggaacagaggcttcgaagcagtgggcaggcagggatcgcttgatctcggtgagagtagggaactcgtagggagcggcaacggtagaggaagccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctacatttctcccttgctccaactatcgattgttgtctactaactatcgtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactaggcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactaggcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaacccta

SEQ ID NO: 70 - DNA, 1080 bp, Pythium aphanidermatum
  CDS (1)..(1080): synthetic delta-17 desaturase (codon-optimized for Yarrowia lipolytica)
atggcttcctctaccgttgccgctccctacgagttccctactctcaccgagatcaagcgatccctgcctgcccactgcttcgaagcctctgttccctggtccctctactataccgtgcgagctctgggcattgccggttcccttgctctcggactgtactatgctcgagcccttgctatcgtgcaggagtttgcactgctcgatgccgtcctttgcactggctacattctgctccagggtatcgtgttctggggattctttaccatcggtcacgactgtggacatggtgccttctcgcgatcccacctgctcaacttctctgttggcacactcattcactccatcattctgactccctacgagtcgtggaagatcagccatcgacaccatcacaagaacaccggcaacatcgacaaggatgagatcttctaccctcagcgagaagccgactctcatcccctgtcccgacacatggtcatctcccttggttcggcttggtttgcctacctcgttgctggatttcctccccgaaaggtcaaccacttcaatccctgggagcctctctacctgcgaagaatgtctgccgtcatcatttccctcggctctctcgtggcctttgctggtctgtacgcctaccttacctacgtctacggcctcaagaccatggctctgtattacttcgcacctctctttggattcgccaccatgctggttgtcactaccttcctccatcacaacgacgaggaaactccctggtacgccgattcggagtggacctatgtcaagggcaacttgtcctctgtggaccgaagctacggagccctcatcgacaacctgtcccacaacattggtacacatcagatccaccatctgtttcccatcattcctcactacaagctcaacgaggccactgctgccttcgctcaggcctttcccgaactggtgcgaaagtcggcttctcccatcattcccaccttcatccgaattggtcttatgtacgccaagtacggcgtggtcgacaaggatgccaagatgtttaccctcaaggaggccaaggctgccaagaccaaagccaactaa

SEQ ID NO: 71 - protein, 359 aa, Pythium aphanidermatum
MASSTVAAPYEFPTLTEIKRSLPAHCFEASVPWSLYYTVRALGIAGSLALGLYYARALAIVQEFALLDAVLCTGYILLQGIVFWGFFTIGHDCGHGAFSRSHLLNFSVGTLIHSIILTPYESWKISHRHHHKNTGNIDKDEIFYPQREADSHPLSRHMVISLGSAWFAYLVAGFPPRKVNHFNPWEPLYLRRMSAVIISLGSLVAFAGLYAYLTYVYGLKTMALYYFAPLFGFATMLVVTTFLHHNDEETPWYADSEWTYVKGNLSSVDRSYGALIDNLSHNIGTHQIHHLFPIIPHYKLNEATAAFAQAFPELVRKSASPIIPTFIRIGLMYAKYGVVDKDAKMFTLKEAKAAKTKAN

SEQ ID NO: 72 - DNA, 1080 bp, Pythium aphanidermatum
  CDS (1)..(1080): delta-17 desaturase
atggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactag

SEQ ID NO: 73 - protein, 359 aa, Pythium aphanidermatum; identical to SEQ ID NO: 71

SEQ ID NO: 74 - DNA, 9570 bp, Artificial Sequence
  Plasmid pY117
ggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggtttaaacgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaattaattaattccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctcatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaagc

SEQ ID NO: 75 - DNA, 15743 bp, Artificial Sequence
  Plasmid pZP2-2988
ggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatctgtatattcggtaagatatattttgtggggttttagtggtgtttaaacagtgtacgcagtactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcaccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctacatttctcccttgctccaactatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcaccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgataacgtctcgtaccaaccacagattacgacccattcgcagtcacagttcactagggtttgggttgcatccgttgagagcggtttgtttttaaccttctccatgtgctcactcaggttttgggttcagatcaaatcaaggcgtgaaccactttgtttgaggacaaatgtgacacaaccaaccagtgtcaggggcaagtccgtgacaaaggggaagatacaatgcaattactgacagttacagactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggcggaacgagcttagtcttcaattgaggtgcgagcgacacaattgggtgtcacgtggcctaattgacctcgggtcgtggagtccccagttatacagcaaccacgaggtgcatgggtaggagacgtcaccagacaatagggttttttttggactggagagggttgggcaaaagcgctcaacgggctgtttggggagctgtgggggaggaattggcgatatttgtgaggttaacggctccgatttgcgtgttttgtcgctcctgcatctccccatacccatatcttccctccccacctctttccacgataattttacggatcagcaataaggttccttctcctagtttccacgtccatatatatctatgctgcgtcgtccttttcgtgacatcaccaaaacacatacaacaatggctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggcctccacctcggctctgcccaagcagaaccctgccctccgacgaaccgtcacttccaccactgtgaccgactcggagtctgctgccgtctctccctccgattctcccagacactcggcctcctctacatcgctgtcttccatgtccgaggtggacattgccaagcccaagtccgagtacggtgtcatgctggatacctacggcaaccagttcgaagttcccgacttcaccatcaaggacatctacaacgctattcccaagcactgcttcaagcgatctgctctcaagggatacggctacattcttcgagacattgtcctcctgactaccactttcagcatctggtacaactttgtgacacccgagtacattccctccactcctgctcgagccggtctgtgggctgtgtacaccgttcttcagggactcttcggtactggactgtgggtcattgcccacgagtgtggacatggtgctttctccgattcccgaatcatcaacgacattactggctgggtgcttcactcttccctgcttgttccctacttcagctggcaaatctcccaccggaagcatcacaaggccactggaaacatggagcgagacatggtcttcgttcctcgaacccgagagcagcaagctactcgactcggcaagatgacccacgaactcgcccatcttaccgaggaaactcctgctttcaccctgctcatgcttgtgcttcagcaactggtcggttggcccaactatctcattaccaacgttactggacacaactaccatgagcggcagcgagagggtcgaggcaagggaaagcacaacggtcttggcggtggagttaaccatttcgatccccgatctcctctgtacgagaacagcgacgccaagctcatcgtgctctccgacattggcattggtcttatggccaccgctctgtactttctcgttcagaagttcggattctacaacatggccatctggtacttcgttccctacttgtgggttaaccactggctcgtcgccattacctttctgcagcacacagatcctactcttccccactacaccaacgacgagtggaactttgtgcgaggtgccgctgcaaccatcgaccgagagatgggcttcattggacgtcatctgctccacggcattatcgagactcacgtcctgcatcactacgtctcttccattcccttctacaatgcggacgaagctaccgaggccatcaaacctatcatgggcaagcactatcgagctgatgtccaggacggtcctcgaggattcattcgagccatgtaccgatctgcacgaatgtgccagtgggttgaaccctccgctggtgccgagggagctggcaagggtgtcctgttctttcgaaaccgaaacaatgtgggcactcctcccgctgtcatcaagcccgttgcctaagc

SEQ ID NO: 76 - DNA, 1434 bp, Fusarium moniliforme
  CDS (1)..(1434): synthetic delta-12 desaturase (codon-optimized for Yarrowia lipolytica)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: WO 2005/047485
  ref <311>: PATENT FILING DATE: 2004-11-12
  ref <312>: PUBLICATION DATE: 2005-05-26
  ref <313>: RELEVANT RESIDUES IN SEQ ID NO: (1)..(1434)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: US 2005-0216975-A1
  ref <311>: PATENT FILING DATE: 2004-11-10
  ref <312>: PUBLICATION DATE: 2005-09-29
  ref <313>: RELEVANT RESIDUES IN SEQ ID NO: (1)..(1434)
atggcctccacctcggctctgcccaagcagaaccctgccctccgacgaaccgtcacttccaccactgtgaccgactcggagtctgctgccgtctctccctccgattctcccagacactcggcctcctctacatcgctgtcttccatgtccgaggtggacattgccaagcccaagtccgagtacggtgtcatgctggatacctacggcaaccagttcgaagttcccgacttcaccatcaaggacatctacaacgctattcccaagcactgcttcaagcgatctgctctcaagggatacggctacattcttcgagacattgtcctcctgactaccactttcagcatctggtacaactttgtgacacccgagtacattccctccactcctgctcgagccggtctgtgggctgtgtacaccgttcttcagggactcttcggtactggactgtgggtcattgcccacgagtgtggacatggtgctttctccgattcccgaatcatcaacgacattactggctgggtgcttcactcttccctgcttgttccctacttcagctggcaaatctcccaccggaagcatcacaaggccactggaaacatggagcgagacatggtcttcgttcctcgaacccgagagcagcaagctactcgactcggcaagatgacccacgaactcgcccatcttaccgaggaaactcctgctttcaccctgctcatgcttgtgcttcagcaactggtcggttggcccaactatctcattaccaacgttactggacacaactaccatgagcggcagcgagagggtcgaggcaagggaaagcacaacggtcttggcggtggagttaaccatttcgatccccgatctcctctgtacgagaacagcgacgccaagctcatcgtgctctccgacattggcattggtcttatggccaccgctctgtactttctcgttcagaagttcggattctacaacatggccatctggtacttcgttccctacttgtgggttaaccactggctcgtcgccattacctttctgcagcacacagatcctactcttccccactacaccaacgacgagtggaactttgtgcgaggtgccgctgcaaccatcgaccgagagatgggcttcattggacgtcatctgctccacggcattatcgagactcacgtcctgcatcactacgtctcttccattcccttctacaatgcggacgaagctaccgaggccatcaaacctatcatgggcaagcactatcgagctgatgtccaggacggtcctcgaggattcattcgagccatgtaccgatctgcacgaatgtgccagtgggttgaaccctccgctggtgccgagggagctggcaagggtgtcctgttctttcgaaaccgaaacaatgtgggcactcctcccgctgtcatcaagcccgttgcctaa

SEQ ID NO: 77 - protein, 477 aa, Fusarium moniliforme; identical to SEQ ID NO: 47

SEQ ID NO: 78 - DNA, 6303 bp, Artificial Sequence
  Plasmid pZKUE3S
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgcatgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtttaaacccggaaccggaatcgataagcttgatatcgaattcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacaccatggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaagc

SEQ ID NO: 79 - DNA, 15877 bp, Artificial Sequence
  Plasmid pZKL1-2SP98C
aaatgatgtcgacgcagtaggatgtcctgcacgggtctttttgtggggtgtggagaaaggggtgcttggatcgatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgctgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctactgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgagtccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctccctttccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagaccgaataagcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaatcgagcttggcgtaatcatggtcatagctgtttcctgtgtgaaattgttatccgctcacaattccacacaacgtacgatagttagtagacaacaatcagaacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgctatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcacggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatgccactgccgatgcggtgcgaacatccctggagggattctcggagctctacacaatgcagattctgtcgtcgagtactctctaccttgctcgaatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatccccttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggcaacgggcttgatgacagcgggaggagtgcccacattgtttcggtttcgaaagaacaggacacccttgccagctccctcggcaccagcggagggttcaacccactggcacattcgtgcagatcggtacatggctcgaatgaatcctcgaggaccgtcctggacatcagctcgatagtgcttgcccatgataggtttgatggcctcggtagcttcgtccgcattgtagaagggaatggaagagacgtagtgatgcaggacgtgagtctcgataatgccgtggagcagatgacgtccaatgaagcccatctctcggtcgatggttgcagcggcacctcgcacaaagttccactcgtcgttggtgtagtggggaagagtaggatctgtgtgctgcagaaaggtaatggcgacgagccagtggttaacccacaagtagggaacgaagtaccagatggccatgttgtagaatccgaacttctgaacgagaaagtacagagcggtggccataagaccaatgccaatgtcggagagcacgatgagcttggcgtcgctgttctcgtacagaggagatcggggatcgaaatggttaactccaccgccaagaccgttgtgctttcccttgcctcgaccctctcgctgccgctcatggtagttgtgtccagtaacgttggtaatgagatagttgggccaaccgaccagttgctgaagcacaagcatgagcagggtgaaagcaggagtttcctcggtaagatgggcgagttcgtgggtcatcttgccgagtcgagtagcttgctgctctcgggttcgaggaacgaagaccatgtctcgctccatgtttccagtggccttgtgatgcttccggtgggagatttgccagctgaagtagggaacaagcagggaagagtgaagcacccagccagtaatgtcgttgatgattcgggaatcggagaaagcaccatgtccacactcgtgggcaatgacccacagtccagtaccgaagagtccctgaagaacggtgtacacagcccacagaccggctcgagcaggagtggagggaatgtactcgggtgtcacaaagttgtaccagatgctgaaagtggtagtcaggaggacaatgtctcgaagaatgtagccgtatcccttgagagcagatcgcttgaagcagtgcttgggaatagcgttgtagatgtccttgatggtgaagtcgggaacttcgaactggttgccgtaggtatccagcatgacaccgtactcggacttgggcttggcaatgtccacctcggacatggaagacagcgatgtagaggaggccgagtgtctgggagaatcggagggagagacggcagcagactccgagtcggtcacagtggtggaagtgacggttcgtcggagggcagggttctgcttgggcagagccgaggtggaggccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgaacagcatgaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaattt

SEQ ID NO: 80 - DNA, 1185 bp, Yarrowia lipolytica
  CDS (1)..(1185): diacylglycerol cholinephosphotransferase (YlCPT1)
  ref <302>: TITLE: HIGH EICOSAPENTAENOIC ACID PRODUCING STRAINS OF
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(1185)
  ref <302>: TITLE: HIGH EICOSAPENTAENOIC ACID PRODUCING STRAINS OF
  ref <310>: PATENT DOCUMENT NUMBER: US 2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(1185)
atgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgttgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctgctgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgaatccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctcccttcccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagactgagtaa

SEQ ID NO: 81 - protein, 394 aa, Yarrowia lipolytica
MGVFIKQEQLPALKKYKYSAEDHSFISNNILRPFWRQFVKIFPLWMAPNMVTLLGFFFVIVNFITMLIVDPTHDREPPRWVYLTYALGLFLYQTFDACDGSHARRTGQSGPLGELFDHCVDAMNTSLILTVVVSTTHMGYNMKLLIVQIAALGNFYLSTWETYHTGTLYLSGFSGPVEGILILVALFVLTFFTGPNVYALTVYEALPESITSLLPASFLDVTITQIYIGFGVLGMVFNIYGACGNVIKYYNNKGKSALPAILGIAPFGIFYVGVFAWAHVAPLLLSKYAIVYLFAIGAAFAMQVGQMILAHLVLAPFPHWNVLLFFPFVGLAVHYIAPVFGWDADIVSVNTLFTCFGATLSIYAFFVLEIIDEITNYLDIWCLRIKYPQEKKTE

SEQ ID NO: 82 - DNA, 15812 bp, Artificial Sequence
  Plasmid pZKL2-5U89GC
gtacgttatcatttgaacagtgaaaggctacagtaacagaagcagttgtaaacttcattccgttgattctgtactacagtaccccactacgccgcttccgctgacactgttcaacccaaaaactacatctgcgtgcgctgtgtaaggctatcatcagatacatactgtagattctgtagatgcgaacctgcttgtatcatatacatccccctccccctgacctgcacaagcaagcaatgtgacattgatattgctgcttatctagtgccgaggatgtgaaagccgagactcaaacatttcttttactctcttgttcctgaccagacctggcggagattacgccagtatgattcttgcaggtctgagacaagcctggaacagccaacatttatttttcgaagcgagaaacatgccacaccccggcacgttcagagatgcatatgatttgtttttcgagtaacagtacccccccccccccccccaatgaaaccagtattactcacaccatcctcattcaaagcgttacactgattacgcgcccatcaacgacagcatgaggggactgctgatctgatctaatcaaatgactacaaaaatcgcaataatgaagagcaaacgacaaaaaagaaacaggttaaccaatcccgcttcaatgtctcaccacaatccagcactgtttctcattacctcctccctctaatttcagagttgcatcagggtccttgatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctggtttcgatttgtcttagaggaacgcatatacagtaatcatagagaataaacgatattcatttattaaagtagatagttgaggtagaagttgtaaagagtgataaatagcttagataccacagacaccctcggtgacgaagtactgcagatggtttccaatcacattgacctgctggagcagagtgttaccggcagagcactgtttattgctctggccctggcacatgacaacgttggagagaggagggtggatcaggggccagtcaataaagacctcaccagagcagtgctggtaaccgtcccagaagggcacttgagggacgatatctcctcggtgggtgattcggtagagctttcggtctttggacaccttggagacatcggggttctcctggccaaagaagagtttatcgacccagttagcaaagccagcgttaccgacaatgggctgaccaagagtaacaacgaggggatcgtggccgttaaccttgaggttgattccgaacagaagggctgcagctcctccgagagagtgaccggtgacagcaatctggtagtcgggatactgctcaatcacagagtcgagcttggggccgatctgattgtaggtgttgttgtaggactggatgaagccattgtggacaagacagtcatcacaagtagcagtagaagagatgttagcagcaagatcaaagttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcgcctccgggatggaccttggcaagaccttccagatcgtagagaatgccgtcgatggcaaccaggtcgggtcgctcgagcagctgctcggtagtaagggagagagccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgctgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctactgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgagtccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctccctttccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagaccgaataagcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaatcgagcttggcgtaatcatggtcatagctgtttcctgtgtgaaattgttatccgctcacaattccacacaac

SEQ ID NO: 83 - DNA, 1164 bp, Enterobacteriaceae DC260
  CDS (1)..(1164): synthetic lycopene cyclase (crtY) (codon-optimized for Yarrowia lipolytica)
atggccacacagtatgacgtcatccttgtcggagccggacttgctaacggtctcatagcccttcgactccgacagctccagccgcagctcaagtgtcttcttctggagtctgacgcccaccccgctggcaaccatacttggtcctttcaccactctgacctgtctgccgaacagctgcgatggctccaaccccttatcactgtgcgatggtctggatatcaggtccggttcccggctcttcgacggaacctggacggcgactactgttctatagcctccggtgacttcgcccgacatctctacgccgcgatgggcgacgacctgtggactaacacagccgttcagcaggttaagccgacccaggtcactctggctgacggtcgagaactcgccgctcaagtcgttattgacggccgaggcctccagcctactccgcacctgcagctgggttaccaggtgttcctcggccaggagtggcaacttgctcagcctcatggcctgcagcagcccatactcatggacgctaccgtggaccagcaggctggctatcgattcgtgtatactctgcctctctcggccgaccgacttctgatcgaagacactcattatgtcaaccagcctgctctcgccgagaatacagcccgacagcacatcgctgactacgccaaccagcaaggatggactctctctaccctcctgcgagaggagcacggaattctccctatcacactctctggtaacatagaccgattctggcagcagcaacgaggccaggcctgttctggacttcgagccggcctgttccatgccactaccggttactcccttccctccgccgtcgctctggctgagcttgtggctgccctgctccccactgacgctctcaccctgtctcagcacatcgaacgattcgcccggcagcaatggcgagagcagcggttctttcgacttctcaaccgaatgctctttcttgctggtaagcctcagcagcgatggcgagttatgcaacgattctaccgacttgacgctggactgatatcgcgattctacgccggtcagctccgacttcgagacaagacccggatactctgtggcaagccgcccgttccgataggtgaggctctccgagccttgcttaactcggtcgaacctggaaagaagaag

SEQ ID NO: 84 - protein, 388 aa, Enterobacteriaceae DC260
MATQYDVILVGAGLANGLIALRLRQLQPQLKCLLLESDAHPAGNHTWSFHHSDLSAEQLRWLQPLITVRWSGYQVRFPALRRNLDGDYCSIASGDFARHLYAAMGDDLWTNTAVQQVKPTQVTLADGRELAAQVVIDGRGLQPTPHLQLGYQVFLGQEWQLAQPHGLQQPILMDATVDQQAGYRFVYTLPLSADRLLIEDTHYVNQPALAENTARQHIADYANQQGWTLSTLLREEHGILPITLSGNIDRFWQQQRGQACSGLRAGLFHATTGYSLPSAVALAELVAALLPTDALTLSQHIERFARQQWREQRFFRLLNRMLFLAGKPQQRWRVMQRFYRLDAGLISRFYAGQLRLRDKTRILCGKPPVPIGEALRALLNSVEPGKKK

SEQ ID NO: 85 - DNA, 1167 bp, Pantoea agglomerans DC404
  CDS (1)..(1167): synthetic lycopene cyclase (crtY) (codon-optimized for Yarrowia lipolytica)
atggagaagtgggatcttatccttgttggagccggactcgctaatggacttattgcctggcggcttaagcagcgacatccgacacttgccgtcctcatgctggagtgcggtgacgctccgggtggcaatcacacctggtcgttccatcagcacgacataactcctgcccagcatgcttggctggctccgctggttgctcatcgatgggatggatacgacgtccactttcccaatgtctcgcggactctccatgacggttatctcactatcacttcgacacggttcgctcaggccatgcgaggtctcatgaaggagaacctgctcaccaacgtcacagtgtcgcgagtctctggacaggaggttactctctccgacggtcgacgattcaccgctggtgccgttatcgatggtcgaggctaccagccttctccgcatctgtctatcggatatcaggccttcattggacaggaatggcagcttacagctccgcatggtctgacccgacctattctcatggatgctcgggtcgctcaaggtaacggttaccgattcgtctacacccttccgctctctgccgacacactgcttatagaggacactcactacatcgacggcccgaccctggacgccgattccgcccgagctcgaattgctgactatgcccggcagcaaggttggcaactggctcgactggtgcgagaggagcagggagcccttccgatcacactctctggagatccggctgccttctggcatcagttccaccatcagccggtgtcgggccttcgggccggtctcttccacgccaccaccggttattcgctgccgctcgccgtccgactggccgatcggatcgccaatgctcccggccttcatcagggagccctgtaccagctcatcgccgacttcgctgctcggcattggcagacccagcgattcttccgactgctgaatcgaatgctgttccttgccggtactcctgaccagcgatggcgagtcatgcagcggttctaccagcttgatgagcagcttatagcccgattctacgctggtcagctgcgatctgccgatcgagctcgacttctcctcggtaagccgcctgtcccgatcgttggtgctatcaaggctctcctgcatacacattcctctcttcgagctcaccataag

SEQ ID NO: 86 - protein, 389 aa, Pantoea agglomerans DC404
MEKWDLILVGAGLANGLIAWRLKQRHPTLAVLMLECGDAPGGNHTWSFHQHDITPAQHAWLAPLVAHRWDGYDVHFPNVSRTLHDGYLTITSTRFAQAMRGLMKENLLTNVTVSRVSGQEVTLSDGRRFTAGAVIDGRGYQPSPHLSIGYQAFIGQEWQLTAPHGLTRPILMDARVAQGNGYRFVYTLPLSADTLLIEDTHYIDGPTLDADSARARIADYARQQGWQLARLVREEQGALPITLSGDPAAFWHQFHHQPVSGLRAGLFHATTGYSLPLAVRLADRIANAPGLHQGALYQLIADFAARHWQTQRFFRLLNRMLFLAGTPDQRWRVMQRFYQLDEQLIARFYAGQLRSADRARLLLGKPPVPIVGAIKALLHTHSSLRAHHK

SEQ ID NO: 87 - DNA, 744 bp, Sphingomonas melonis DC18
  CDS (1)..(744): synthetic beta-carotene ketolase  (crtW) (codon-optimized for Yarrowia lipolytica)
atggctgtcgatcacgacgctcgaatctccctccttctggctgccgctataggagccgcctggcttgccatccatgttggcgctatagtgtggtggcgatggtctccggctaccgctgttcttgctattcccgttgtcctggtgcaggcctggctgtctacaggtcttttcattgtcgctcacgattgcatgcacggttcctttgtccctggccgacccgctgtgaaccgaaccgtgggcaccctctgcctcggtgcctatgccggtctgtcttacggccaactccatccgaagcatcatgcccatcatgatgctcccggtactgccgctgaccccgatttccatgctggcgctccccgatctgccctgccctggtttgcccgattcttcacatcttactacactcatggtcagatacttcggataactgctgctgctgtcctttacatgctgcttggagtgtcgcttctcaacatcgtggtcttctgggctctccccgcccttatcgcccttgctcagctgttcgtcttcggtaccttccttccccatcgacacggagacactcctttcgccgacgcccacaatgcccgatccaacggatggccgcgactggcctccctcgccacttgcttccacttcggtgcctatcatcatgagcaccacctttctccgtggaccccttggtggcagctccctcgggttggtcagcctgctgccggtcatcgatccctttctaaggaccga

SEQ ID NO: 88 - protein, 248 aa, Sphingomonas melonis DC18
MAVDHDARISLLLAAAIGAAWLAIHVGAIVWWRWSPATAVLAIPVVLVQAWLSTGLFIVAHDCMHGSFVPGRPAVNRTVGTLCLGAYAGLSYGQLHPKHHAHHDAPGTAADPDFHAGAPRSALPWFARFFTSYYTHGQILRITAAAVLYMLLGVSLLNIVVFWALPALIALAQLFVFGTFLPHRHGDTPFADAHNARSNGWPRLASLATCFHFGAYHHEHHLSPWTPWWQLPRVGQPAAGHRSLSKDR

SEQ ID NO: 89 - DNA, 726 bp, Agrobacterium aurantiacum
  CDS (1)..(726): synthetic beta-carotene ketolase  (crtW) (codon-optimized for Yarrowia lipolytica)
atggctgctcacgcacttcccaaggctgacctcaccgctaccagcctgatcgtctctggtggaatcatcgctgcctggcttgctctccacgtgcatgcactgtggttccttgacgcagctgctcaccccattcttgctatcgccaacttcctcggtctcacttggcttagcgtcggactgttcatcattgctcatgacgccatgcacggttctgtcgttcctggtcgacccagagccaatgctgctatgggtcagctggttctgtggctctatgctggtttctcctggcgaaagatgatcgtcaagcacatggctcaccatcgacacgctggcactgacgatgaccccgacttcgaccacggaggtcccgtccgatggtatgctcgattcataggcacttacttcggatggcgagagggactgctcctgcccgtcatcgtcactgtgtacgctctgatacttggtgatcgatggatgtatgtggtcttctggcctcttcctagcattctggcctcgatccagctgttcgtgttcggaacatggctccctcaccgacctggacatgacgccttccctgatcgacacaatgctcgaagctcccgaatctctgaccctgttagcctcctgacatgcttccatttcggaggataccaccatgagcatcaccttcatcctactgttccctggtggcgacttcctagcacccgaacaaagggagacactgcc

SEQ ID NO: 90 - protein, 242 aa, Agrobacterium aurantiacum
MAAHALPKADLTATSLIVSGGIIAAWLALHVHALWFLDAAAHPILAIANFLGLTWLSVGLFIIAHDAMHGSVVPGRPRANAAMGQLVLWLYAGFSWRKMIVKHMAHHRHAGTDDDPDFDHGGPVRWYARFIGTYFGWREGLLLPVIVTVYALILGDRWMYVVFWPLPSILASIQLFVFGTWLPHRPGHDAFPDRHNARSSRISDPVSLLTCFHFGGYHHEHHLHPTVPWWRLPSTRTKGDTA

SEQ ID NO: 91 - DNA, 486 bp, Brevundimonas vesicularis DC263
  CDS (1)..(486): synthetic beta-carotene hydroxylase  (crtZ) (codon-optimized for Yarrowia lipolytica)
atggcgtggcctactatgattctgctgttccttgctacgttccttggtatggaggtcttcgcttgggcaatgcaccgatacgtcatgcatggtctcctttggacctggcaccgatctcatcacgagcctcatgacgatgtcctggaacggaatgacctgttcgctgtcgtgttcgctgcacctgccatcatactcgttgctctcggactgcatctgtggccttggatgctgcccatcggtctcggagtcactgcttacggactggtgtacttcttctttcacgacggtctggtgcatcgacgatttcccactggaatagctggacgaagtgccttctggactcgacggatccaggctcaccgactgcatcacgctgtccgaactcgagagggatgtgtctcctttggtttcctctgggtccgatctgctcgagcactgaaggctgagctctctcagaagcgaggatcctcttcgaacggtgcatag

SEQ ID NO: 92 - protein, 161 aa, Brevundimonas vesicularis DC263; identical to SEQ ID NO: 19

SEQ ID NO: 93 - DNA, 486 bp, Agrobacterium aurantiacum
  CDS (1)..(486): synthetic beta-carotene hydroxylase  (crtZ) (codon-optimized for Yarrowia lipolytica)
atggccaacttccttatcgtcgtcgccactgtgctcgtgatggagctcactgcctactctgtccaccgatggataatgcacggaccgcttggctggggttggcacaagtctcaccacgaagagcacgatcatgctcttgagaagaacgacctttacggactcgtcttcgccgttatcgctactgtcctcttcaccgtgggatggatctgggctccggtcctctggtggatcgctcttggtatgaccgtctatggcctcatctacttcgttctgcacgacggcctcgtgcaccaacgatggcccttccgatacattccgcgaaagggttatgctcgacgactgtaccaggcccaccgactccatcacgctgtcgagggtcgagatcactgcgtctccttcggcttcatctatgctccgcccgttgataagcttaagcaggacctgaagatgtctggtgttctccgagctgaggctcaggagcgaaca

SEQ ID NO: 94 - protein, 162 aa, Agrobacterium aurantiacum
MANFLIVVATVLVMELTAYSVHRWIMHGPLGWGWHKSHHEEHDHALEKNDLYGLVFAVIATVLFTVGWIWAPVLWWIALGMTVYGLIYFVLHDGLVHQRWPFRYIPRKGYARRLYQAHRLHHAVEGRDHCVSFGFIYAPPVDKLKQDLKMSGVLRAEAQERT

SEQ ID NO: 95 - DNA, 13625 bp, artificial sequence
  Plasmid pYPS147
gatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggcttcccagtacgacctgctccttctcggagctggtctggccaacggactcctggctctccgactgaaagccttgcagcctcaactgcgagtcttggttcttgatgctcacgcacacgctggtggcaaccatacctggtgcttccacgaggaagacctctctgctgcccagcatcagtggattgctcccttggtcgcacatcgttggcctcactacgaggttcgatttcccgctctgactagacagctcaactccggttacttctgtgtcacctcggcacgatttgacgaggttctgcgagccactctcggagatgctctgcgactcaaccagaccgtcgcatcctctggtccagaccacgttcagcttgccagcggcgaagtgctccgagctagagccgtcattgatggacgaggttaccaacccgacgctgcccttcagattggatttcagtccttcgttggtcaggagtggcgactgtctcagcctcatcagctcgaaggtcccattctgatggacgctgccgtggatcagcaaggaggctaccgtttcgtctatacacttcctctctcgcccacccgactgctcattgaggacactcactacatcaacgatgcctccttggctacagcacaggctcgacagaacatctgcgactacgccactcgacaaggatggcagctggagaccctgttgcgagaagagcgaggtgctctgcccatcactcttgcaggcgacttcgatcggttttggcatcaccgtgctccctgtgttggactgagagccggtctcttccatcctaccacaggttactcccttccactggctgccaccctcgctgacgccttggctgccgaggctgacttctctcccgaagcactcgctcctcgtattcaccgatttgcccaggctgcctggcgaaagcaaggctttttcagaatgttgaatcgaatgctgtttcttgctgccgagggagatcgaagatggcgagtcatgcagcgtttctacggtctgcccgagggcttgattgcccgattctatgctggacgactcacacttgccgacagagctcggattctcagcggaaagcctcccgttcctgtgctggctgccctccaggccatccttactcatccttctggtcgaagagcttcacgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttactgtatattcggtaagatatattttgtggggttttagtggtgtttggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttaattaactttggccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttacttcttctttccaggttcgaccgagttaagcaaggctcggagagcctcacctatcggaacgggcggcttgccacagagtatccgggtcttgtctcgaagtcggagctgaccggcgtagaatcgcgatatcagtccagcgtcaagtcggtagaatcgttgcataactcgccatcgctgctgaggcttaccagcaagaaagagcattcggttgagaagtcgaaagaaccgctgctctcgccattgctgccgggcgaatcgttcgatgtgctgagacagggtgagagcgtcagtggggagcagggcagccacaagctcagccagagcgacggcggagggaagggagtaaccggtagtggcatggaacaggccggctcgaagtccagaacaggcctggcctcgttgctgctgccagaatcggtctatgttaccagagagtgtgatagggagaattccgtgctcctctcgcaggagggtagagagagtccatccttgctggttggcgtagtcagcgatgtgctgtcgggctgtattctcggcgagagcaggctggttgacataatgagtgtcttcgatcagaagtcggtcggccgagagaggcagagtatacacgaatcgatagccagcctgctggtccacggtagcgtccatgagtatgggctgctgcaggccatgaggctgagcaagttgccactcctggccgaggaacacctggtaacccagctgcaggtgcggagtaggctggaggcctcggccgtcaataacgacttgagcggcgagttctcgaccgtcagccagagtgacctgggtcggcttaacctgctgaacggctgtgttagtccacaggtcgtcgcccatcgcggcgtagagatgtcgggcgaagtcaccggaggctatagaacagtagtcgccgtccaggttccgtcgaagagccgggaaccggacctgatatccagaccatcgcacagtgataaggggttggagccatcgcagctgttcggcagacaggtcagagtggtgaaaggaccaagtatggttgccagcggggtgggcgtcagactccagaagaagacacttgagctgcggctggagctgtcggagtcgaagggctatgagaccgttagcaagtccggctccgacaaggatgacgtcatactgtgtggccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggagaagtgggatcttatccttgttggagccggactcgctaatggacttattgcctggcggcttaagcagcgacatccgacacttgccgtcctcatgctggagtgcggtgacgctccgggtggcaatcacacctggtcgttccatcagcacgacataactcctgcccagcatgcttggctggctccgctggttgctcatcgatgggatggatacgacgtccactttcccaatgtctcgcggactctccatgacggttatctcactatcacttcgacacggttcgctcaggccatgcgaggtctcatgaaggagaacctgctcaccaacgtcacagtgtcgcgagtctctggacaggaggttactctctccgacggtcgacgattcaccgctggtgccgttatcgatggtcgaggctaccagccttctccgcatctgtctatcggatatcaggccttcattggacaggaatggcagcttacagctccgcatggtctgacccgacctattctcatggatgctcgggtcgctcaaggtaacggttaccgattcgtctacacccttccgctctctgccgacacactgcttatagaggacactcactacatcgacggcccgaccctggacgccgattccgcccgagctcgaattgctgactatgcccggcagcaaggttggcaactggctcgactggtgcgagaggagcagggagcccttccgatcacactctctggagatccggctgccttctggcatcagttccaccatcagccggtgtcgggccttcgggccggtctcttccacgccaccaccggttattcgctgccgctcgccgtccgactggccgatcggatcgccaatgctcccggccttcatcagggagccctgtaccagctcatcgccgacttcgctgctcggcattggcagacccagcgattcttccgactgctgaatcgaatgctgttccttgccggtactcctgaccagcgatggcgagtcatgcagcggttctaccagcttgatgagcagcttatagcccgattctacgctggtcagctgcgatctgccgatcgagctcgacttctcctcggtaagccgcctgtcccgatcgttggtgctatcaaggctctcctgcatacacattcctctcttcgagctcaccataagtaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacaccactaaaaccccacaaaatatatcttaccgaatataca

SEQ ID NO: 96 - DNA, 12829 bp, artificial sequence
  Plasmid pYPS162
cgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaggctccgttcgaagaggaacctcgcttctgagacagctcagccttgagggctcgagcggatctaacccaaaggaagccgaacgagacgcatccctctcgggttcgcactgcgtgatgcagtctgtgagcctggattcgtcttgtccagaaggcagatcgaccagcaatgccagtgggaaaccgtcgatggacgagaccgtcgtgaaagaagaagtacaccagtccgtaggcagtaacgccgagtccgatgggaagcatccaaggccacagatggagacccaaagcgacgagaatgatggcaggtgcagcgaacacgacggcaaacaggtcgtttcgctcgagaacatcgtcgtggggttcgtgatgagaacgatgccaagtccacaacagaccgtgcatgacgtatcggtgcatagcccaggcgaagacctccattccgagaaaggtagcaaggaagagcaggatcatggtaggccaagccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggcgtggcctactatgattctgctgttccttgctacgttccttggtatggaggtcttcgcttgggcaatgcaccgatacgtcatgcatggtctcctttggacctggcaccgatctcatcacgagcctcatgacgatgtcctggaacggaatgacctgttcgctgtcgtgttcgctgcacctgccatcatactcgttgctctcggactgcatctgtggccttggatgctgcccatcggtctcggagtcactgcttacggactggtgtacttcttctttcacgacggtctggtgcatcgacgatttcccactggaatagctggacgaagtgccttctggactcgacggatccaggctcaccgactgcatcacgctgtccgaactcgagagggatgtgtctcctttggtttcctctgggtccgatctgctcgagcactgaaggctgagctctctcagaagcgaggatcctcttcgaacggtgcataggcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacaccactaaaaccccacaaaatatatcttaccgaatatacagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggccaacttccttatcgtcgtcgccactgtgctcgtgatggagctcactgcctactctgtccaccgatggataatgcacggaccgcttggctggggttggcacaagtctcaccacgaagagcacgatcatgctcttgagaagaacgacctttacggactcgtcttcgccgttatcgctactgtcctcttcaccgtgggatggatctgggctccggtcctctggtggatcgctcttggtatgaccgtctatggcctcatctacttcgttctgcacgacggcctcgtgcaccaacgatggcccttccgatacattccgcgaaagggttatgctcgacgactgtaccaggcccaccgactccatcacgctgtcgagggtcgagatcactgcgtctccttcggcttcatctatgctccgcccgttgataagcttaagcaggacctgaagatgtctggtgttctccgagctgaggctcaggagcgaacataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttactgtatattcggtaagatatattttgtggggttttagtggtgtttggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttaattaattccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctcattt

SEQ ID NO: 97 - DNA, 12380 bp, artificial sequence
  Plasmid pYPS152
aaacaccactaaaaccccacaaaatatatcttaccgaatatacagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggctgctcacgcacttcccaaggctgacctcaccgctaccagcctgatcgtctctggtggaatcatcgctgcctggcttgctctccacgtgcatgcactgtggttccttgacgcagctgctcaccccattcttgctatcgccaacttcctcggtctcacttggcttagcgtcggactgttcatcattgctcatgacgccatgcacggttctgtcgttcctggtcgacccagagccaatgctgctatgggtcagctggttctgtggctctatgctggtttctcctggcgaaagatgatcgtcaagcacatggctcaccatcgacacgctggcactgacgatgaccccgacttcgaccacggaggtcccgtccgatggtatgctcgattcataggcacttacttcggatggcgagagggactgctcctgcccgtcatcgtcactgtgtacgctctgatacttggtgatcgatggatgtatgtggtcttctggcctcttcctagcattctggcctcgatccagctgttcgtgttcggaacatggctccctcaccgacctggacatgacgccttccctgatcgacacaatgctcgaagctcccgaatctctgaccctgttagcctcctgacatgcttccatttcggaggataccaccatgagcatcaccttcatcctactgttccctggtggcgacttcctagcacccgaacaaagggagacactgcctaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttactgtatattcggtaagatatattttgtggggttttagtggtgtttggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttaattaactttggccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcctatcggtccttagaaagggatcgatgaccggcagcaggctgaccaacccgagggagctgccaccaaggggtccacggagaaaggtggtgctcatgatgataggcaccgaagtggaagcaagtggcgagggaggccagtcgcggccatccgttggatcgggcattgtgggcgtcggcgaaaggagtgtctccgtgtcgatggggaaggaaggtaccgaagacgaacagctgagcaagggcgataagggcggggagagcccagaagaccacgatgttgagaagcgacactccaagcagcatgtaaaggacagcagcagcagttatccgaagtatctgaccatgagtgtagtaagatgtgaagaatcgggcaaaccagggcagggcagatcggggagcgccagcatggaaatcggggtcagcggcagtaccgggagcatcatgatgggcatgatgcttcggatggagttggccgtaagacagaccggcataggcaccgaggcagagggtgcccacggttcggttcacagcgggtcggccagggacaaaggaaccgtgcatgcaatcgtgagcgacaatgaaaagacctgtagacagccaggcctgcaccaggacaacgggaatagcaagaacagcggtagccggagaccatcgccaccacactatagcgccaacatggatggcaagccaggcggctcctatagcggcagccagaaggagggagattcgagcgtcgtgatcgacagccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatgggacaggctaaccgaatgctcaccggtcctcgatgtgccaagtgccgagccatgtccgctgtcactcccatgtctcgagttgtgcctaaccaggctctgatcggactcacccttgccggtctcattgcagctgcctggctgactcttcacatctacggagtctacttccacagatggaccatctggtccgtccttacagttcccttgatcgtcgctggtcagacctggctctctgttggcctcttcattgtcgctcacgatgccatgcacggatcccttgctccagcacgacctagactgaacactgccattggttctctcgcacttgccctgtacgctggctttcgattcactcctctcaagacagcccaccatgctcaccatgccgcacctggtactgctgatgatcccgactttcatgccgatgctcctcgagcctttctgccctggttctatggcttctttcgaacctacttcggatggcgagagcttgctgtcctcaccgttcttgtcgccgttgctgtcctcattctgggtgcccgaatgccaaacttgctggtcttctgggctgcacctgctctccttagcgccttgcaactgttcacctttggcacttggctccctcatcgacacaccgacgatgcctttcccgacaatcacaacgctcgaacttctccctttggacctgttctgtcccttctgacctgtttccacttcggtcgacatcacgagcatcacctcactccctggaagccttggtggtctctgttctcctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgttt

SEQ ID NO: 98 - DNA, 4313 bp, artificial sequence
  pZKUM
taatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaat

SEQ ID NO: 99 - DNA, 1459 bp, Artificial Sequence
  Synthetic mutant Ura3 gene, comprising a 33 bp deletion from +21 to +53, a  1 bp deletion at +376 and a 3 bp deletion from +400 to 403 of the Yarrowia Ura3 coding region (GenBank Accession No. AJ306421)
gagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgac

What is claimed is:

1. A pigmented oleaginous yeast biomass comprising a recombinant *Yarrowia lipolytica* capable of accumulating at least 25 weight percent of its dry cell weight as oil and capable of producing (i) a commercially significant amount of at least one carotenoid compound selected from the group consisting of: astaxanthin, β-carotene, lycopene, zeaxanthin, lutein and canthaxanthin and (ii) high level production of at least one polyunsaturated fatty acid selected from the group consisting of an omega-3 polyunsaturated fatty acid and an omega-6 polyunsaturated fatty acid.

2. The pigmented oleaginous yeast biomass of claim 1 wherein the omega-3 or the omega-6 polyunsaturated fatty acid is selected from the group consisting of: alpha-linolenic acid, arachidonic acid, eicosapentaenoic acid, docosapentaenoic acid, and docosahexaenoic acid.

3. The pigmented oleaginous yeast biomass of claim 1, wherein the recombinant *Yarrowia lipolytica* comprises:
   a) at least one copy of a crtE gene encoding a geranyl pyrophosphate synthase;
   b) at least one copy of a crtB gene encoding a phytoene synthase;
   c) at least one copy of a crtI gene encoding a phytoene desaturase;
   d) at least one copy of a crtY gene encoding a lycopene cyclase;
   e) at least one copy of a crtZ gene encoding a carotenoid hydroxylase; and
   f) at least one copy of a crtW gene encoding a carotenoid ketolase.

4. The pigmented oleaginous yeast biomass of claim 3, wherein the recombinant *Yarrowia lipolytica* further comprises:
   a) at least one gene encoding a resveratrol synthase;
   b) at least one gene encoding a coumaroyl-CoA ligase; and
   c) at least one gene encoding a polypeptide having both phenylalanine ammonia lyase activity and tyrosine ammonia lyase activity.

5. The pigmented oleaginous yeast biomass of claim 2, wherein the recombinant *Yarrowia lipolytica* comprises at least 10% by weight eicosapentaenoic acid in the total lipids of the *Yarrowia lipolytica*.

* * * * *